US007919467B2

(12) United States Patent
Ramakrishna et al.

(10) Patent No.: US 7,919,467 B2
(45) Date of Patent: Apr. 5, 2011

(54) CYTOTOXIC T-LYMPHOCYTE-INDUCING IMMUNOGENS FOR PREVENTION, TREATMENT, AND DIAGNOSIS OF CANCER

(75) Inventors: Venky Ramakrishna, Riegelsville, PA (US); Mark M. Ross, Charlottesville, VA (US); Ramila Philip, Ivyland, PA (US); Lorraine H. Keller, Pipersville, PA (US)

(73) Assignee: Immunotope, Inc., Doylestown, PA (US)

( * ) Notice: Subject to any disclaimer, the term of this patent is extended or adjusted under 35 U.S.C. 154(b) by 560 days.

(21) Appl. No.: 11/426,161

(22) Filed: Jun. 23, 2006

(65) Prior Publication Data
US 2008/0207497 A1 Aug. 28, 2008

Related U.S. Application Data

(63) Continuation-in-part of application No. 10/006,177, filed on Dec. 4, 2001, now Pat. No. 7,083,789.

(60) Provisional application No. 60/251,022, filed on Dec. 4, 2000, provisional application No. 60/256,824, filed on Dec. 20, 2000.

(51) Int. Cl.
*A61K 38/16* (2006.01)
*A61P 35/00* (2006.01)

(52) U.S. Cl. .................................................. 514/19.3

(58) Field of Classification Search ............... 424/185.1
See application file for complete search history.

(56) References Cited

U.S. PATENT DOCUMENTS

| | | | |
|---|---|---|---|
| 4,235,871 A | 11/1980 | Papahadjopoulos et al. | |
| 4,501,728 A | 2/1985 | Geho et al. | |
| 4,690,915 A | 9/1987 | Rosenberg | |
| 4,722,848 A | 2/1988 | Paolette et al. | |
| 4,837,028 A | 6/1989 | Allen | |
| 4,844,893 A | 7/1989 | Honski et al. | |
| 5,019,369 A | 5/1991 | Presant et al. | |
| 5,635,363 A | 6/1997 | Altman et al. | |
| 5,645,994 A | 7/1997 | Huang et al. | |
| 5,747,269 A | 5/1998 | Rammensee et al. | |
| 5,763,219 A | 6/1998 | Keyomarsi | |
| 5,972,643 A | 10/1999 | Lobanenkov | |
| 6,140,464 A | 10/2000 | Pfreundschuh et al. | |
| 6,168,804 B1 * | 1/2001 | Samuel et al. | 424/450 |
| 6,548,064 B1 | 4/2003 | Tureci et al. | |
| 6,867,283 B2 | 3/2005 | Barnea | |
| 7,083,789 B2 | 8/2006 | Ramakrishna et al. | |
| 7,087,712 B1 | 8/2006 | Brossart et al. | |
| 7,270,819 B2 | 9/2007 | Tureci et al. | |
| 2004/0236091 A1 * | 11/2004 | Chicz et al. | 536/23.5 |

FOREIGN PATENT DOCUMENTS

| WO | 93/10814 | 6/1993 |
|---|---|---|
| WO | WO 02/46416 | 6/2002 |
| WO | WO 2007/081680 | 7/2007 |

OTHER PUBLICATIONS

Smith et al. (Nature Biotechnology 15:1222-1223 (1997)).*
Brenner (Trends in Genetics 15:132-133 (1999)).*
Voskoglou-Nomikos (Clin. Can. Res. 9:4227-4239 (2003)).*
Dennis (Nature 442:739-741 (2006)).*
Cespdes et al. (Clin. Transl. Oncol. 8(5):318-329 (2006)).*
Talmadge et al. (Am. J. Pathol 170(3):793-804 (2007)).*
clinicaltrials.gov search (ImmunoVaccine Technologies, Inc., pp. 1-3; Jan. 29, 2011).*
Adachi et al., 1992, Nucleic Acids Research, vol. 20, pp. 5297-5303.
Boon, T. et al., Ann. Rev. Immunol., 12:337-365 (1994).
Celluzzi, C. M. et al., J. Exp. Med., 183:283-287 (1996).
European Search Report, dated Jan. 26, 2005.
Gilboa, E., Immunity, 11:263-270 (1999).
Gluzman, Cell, 23:175 (1981).
Harding, C. H. III, Eur. J. Immunol. 22:1865-1869 (1992).
Henderson R. A. et al, Direct Identification of an Endogenous Peptide Reognized by Multiple HLA-A2.1 Specific Cytotoxic T Cells, National Academy of Sciences, vol. 90, pp. 10275-10279 (Nov. 1993).
Hogan, K. T. et al., The peptide Recognized by HLAA68.2-Restricted, Squamous Cell Carcinoma of the Lung-Specific Cytotoxic T Lymphocytes is Derviced froma Mutated Elongation Factor 2 Gene, American Association for Cancer Research, vol. 58, No. 22, pp. 5144-5150 (Nov. 15, 1998).
Hunt, D. F. et al., Proc. Natl. Acad. Sci. USA, 83:6233-6237 (1986).
Hunt, D. F. et al., Science, 255:1261-1263 (1992).
Jacob, L. et al., Int. J. Cancer, 71:325-332 (1997).
Joslyn G. et al., Identification of Deletion Mutations and Three New Genes at the Familial Polyposis Locus, Cell, vol. 66, No. 3, pp. 604-614 (1991).
Kabat et al., J. Biol. Chem., 252:6609-6616 (1977).
Kinzler, K. W. et al., Identification of FAP Locus Genes from Chromosome 5Q21, Science, vol. 253, No. 5020, pp. 661-665 (1991).
Lauritzsen et al (International Journal of Cancer, 1998, vol. 78, pp. 216-222.
Ljunggren, H. G. et al., Nature, 346:476-480 (1990).
Loannides, C. G. et al., J. Immunol., 146:1700-1707 (1991).
Mayordome, J. et al., Nat. Med., 1:1297-1302 (1995).
Moore, J. W. et al., Cell, 54:777-785 (1988).
North, R. J. et al., Infect. Immun., 67:2010-2012 (1999).
Parkhurst, M. R. et al., J. Immunol., 157:2539-2548 (1996).
Peiper, M. et al., Eur. J. Immunol., 27:1115-1123 (1997).
Peoples, G.E. et al., Surgery, 114:227-234 (1993).
Perez-Diez, A. et al., Cancer Res., 58:5305-5309 (1998).
Plebanski et al., Eur. J. Immunol., 25:1783 (1995).
Posneft, D. N. et al., J. Biol. Chem., 263:1719-1725 (1988).
Reddy, R. et al., J. Immunol Methods, 141:157-163 (1991).
Riddell, S. R. et al., J. Immunol. Methods, 128:189-201 (1990).
Riddell, S. R. et al., Science, 257:238-241 (1992).
Rock, K. L. et al., Ann. Rev. Immunol., 17:739-779 (1999).
Rosenberg, S. A. et al., A New Era for Cancer Immunotherapy Based on the Genes that encode cancer antigens, Immunity, Cell Press, US, vol. 10, No. 3, pp. 281-287 (Mar. 1999).

(Continued)

*Primary Examiner* — Lynn Bristol
(74) *Attorney, Agent, or Firm* — Ballard Spahr LLP

(57) ABSTRACT

The present invention relates to compositions and methods for the prevention, treatment, and diagnosis of cancer, especially carcinomas, such as ovarian carcinoma. The invention discloses peptides, polypeptides, and polynucleotides that can be used to stimulate a CTL response against cancer.

14 Claims, No Drawings

OTHER PUBLICATIONS

Rosenberg, S. A. et al., N. Engl. J. Med., 319:1676-1680 (1988).
Rosenberg, S. A. et al., Nat. Med., 4:321-327 (1998).
Sarma et al., Journal of Experimental Medicine, 1999, vol. 189, pp. 811-820.
Schendel, D. J. et al., J. Immunol., 151:4209-4220 (1993).
Sherman, LA et al., 1998, Critical Reviews in Immunol., 18(1-2): 47-54.
Slingluff, C. L. Jr. et al., Cancer Res., 54:2731-2737 (1994).
Slingluff, C. L. Jr. et al., J. Immunol., 150:2955-2963 (1993).
Slovin, S.F. et al., J. Immunol., 137:3042-3048 (1987).
Tsai-Pflugfelder et al., Cloning and sequencing of cDNA encoding human DNA topoisomerase II and localization of the gene to chromosome region 17q21-22, Proc. Natl. Acad. Sci. USA, vol. 85, pp. 7177-7181 (1988).
Tuting, T. et al., J. Immunol., 160:1139-1147 (1998).
Voet et al., Biochemistry, John Wiley & Sons, 1990, pp. 60-63 only.
Walter, E. A. et al., N. Engl. J. Med., 333:1038-1044 (1995).
Watts, C., Ann. Rev. Immunol., 15:821-850 (1997).
Wolfel, T. et al., Int. J. Cancer, 54:636-644 (1993).
Yasumura, S. et al., Cancer Res., 53:1461-1468 (1993).
Yewdell, J. W. et al., Ann. Rev. Immunol., 17:51-88 (1999).
Yoshino, I. et al., cancer Res., 54:3387-3390 (1994).
Zeh, H. J. III et al., Hum. Immunol., 39:79-86 (1994).
Zitvogel, L. et al., J. Exp. Med., 183:87-97 (1996).
Hengstler et al. (1999) Cancer Research 59, 3206-3214.
Imal et al. (1995) Clinical Cancer Research 1, 417-424.
Mosolits et al. (1999) Cancer Immunol. Immunother. 47, 315-320 (first page only).
Fisk Bryan et al., "Identification of naturally processed human ovarian peptides recognized by tumor-associated CD8+ cytotoxic T lymphocytes"—Cancer Research, vol. 57, No. 1, 1997, pp. 87-93.
Fisk B et al., "Identification of an Immunodominant Peptide of HER-2/neu Protooncogene Recognized by Ovarian Tumor-specific Cytotoxic T Lymphocyte Lines"—The Journal of Experimental Medicine, Rockefeller University Press, United States, vol. 181, No. 6, Jun. 1, 1995, pp. 2109-2117.
Huynh Khanh D et al., "BCor, a novel corepressor involved in BCL-6 repression"—Genes and Development, vol. 14, No. 14, Jul. 15, 2000, pp. 1810-1823.
Ramakrishna V et al., "Generation and Phenotypic Characterization of New Human Ovarian Cancer Cell Lines With the Identification of Antigens Potetially Recognizable by HLA-Restricted Cytotoxic T Cells"—Journal of Cancer, John Wiley & Sons, Inc., United States, Switzerland, Germany vol. 73, No. 1, Sep. 26, 1997, pp. 143-150.
EPO 019995455.1—Office Action (Feb. 29, 2008).
EPO 019995455.1—Result of Consultation (Aug. 13, 2009).
EPO 019995455.1—Minutes of Oral Proceedings (Oct. 11, 2010).
EPO 019995455.1—Decision to Refuse a European Patent Application (Nov. 10, 2010).
Arceci, Journal of Molecular Medicine, 76, 1998.
Benjamini et al (edited by); Immunology: A Short Course, p. 40, 1991.
Bodey et al; Anticancer Research, 20, 2000.
Boon, Advances in Cancer Research, 58, 1992.
Cox et al, Science, 264, 1994.
Deppenmeier et al (SwissProt, Accession No. Q8PWE3, version 1, p. 1, available Oct. 1, 2002).
Elgert et al., Immunology: Understanding the Immune System, 1996.
Lollini et al. Curr. Cancer Drug Targets 5(3), 2005.
Lollini et al., Trends Immunol, 24(2); (2003).
National Cancer Institute (Cancer Facts, Fact Sheet 5, 1998.
Rongcun, Y et al., Journal of Immunology, 163, 1999.
Wang, et al., Exp. Opin. Biol. Ther., 1(2), 2001.
Watson et al. (edited by), Molecular Biology of the Gene, p. 43 (1988).
Zhou et al., J. Exp. Med., 183:87-97 (1996).
PCT/US2001/047290 ISR (Date of Report—Sep. 14, 2005).
PCT/US2007/077250 ISR (Date of Report—Aug. 21, 2008).
PCT/US2007/024787 ISR (Date of Report—Sep. 18, 2008).
EPO 10178439.5—Search Report (Feb. 3, 2011).
Schirle, Markus, et al.; Identification of tumor-associated MHC class I ligands by a novel T cell-independent approach; European Journal of Immunology, Aug. 1, 2000, vol. 30, No. 8, pp. 2216-2225.

* cited by examiner

CYTOTOXIC T-LYMPHOCYTE-INDUCING IMMUNOGENS FOR PREVENTION, TREATMENT, AND DIAGNOSIS OF CANCER

CROSS-REFERENCE TO RELATED APPLICATIONS

This application is a continuation-in-part of U.S. application Ser. No. 10/006,177, filed Dec. 4, 2001, and now U.S. Pat. No. 7,083,789, which claims priority from U.S. provisional application No. 60/251,022, filed Dec. 4, 2000, and U.S. provisional application No. 60/256,824, filed Dec. 20, 2000, the disclosures of which are all herein incorporated by reference in their entireties.

FIELD OF THE INVENTION

The present invention relates generally to the field of immunogens whose structures incorporate polypeptides comprising epitopic peptides derived from proteins expressed by cancer cells and to uses of said immunogens in eliciting cytotoxic T lymphocyte (CTL) responses for the diagnosis, prevention and treatment of cancer, preferably carcinoma, most preferably ovarian carcinoma.

BACKGROUND OF THE INVENTION

The mammalian immune system has evolved a variety of mechanisms to protect the host from cancerous cells, an important component of this response being mediated by cells referred to as T cells. Cytotoxic T lymphocytes (CTLs) are specialized T cells that function primarily by recognizing and killing cancerous cells or infected cells, but also by secreting soluble molecules referred to as cytokines that can mediate a variety of effects on the immune system.

Evidence suggests that immunotherapy designed to stimulate a tumor-specific CTL response would be effective in controlling cancer. For example, it has been shown that human CTLs recognize sarcomas (Slovin, S. F. et al., J. Immunol., 137:3042-3048, (1987)), renal cell carcinomas (Schendel, D. J. et al., J. Immunol., 151:4209-4220, (1993)), colorectal carcinomas (Jacob, L. et al., Int. J. Cancer, 71:325-332, (1997)), ovarian carcinomas (Loannides, C. G. et al., J. Immunol., 146:1700-1707, (1991)) (Peoples, G. E. et al., Surgery, 114:227-234, (1993)), pancreatic carcinomas (Peiper, M. et al., Eur. J. Immunol., 27:1115-1123, (1997); Wolfel, T. et al., Int. J. Cancer, 54:636-644, (1993)), squamous tumors of the head and neck (Yasumura, S. et al., Cancer Res., 53:1461-1468, (1993)), and squamous carcinomas of the lung (Slingluff, C. L. Jr et al., Cancer Res., 54:2731-2737, (1994); Yoshino, I. et al., Cancer Res., 54:3387-3390, (1994)). The largest number of reports of human tumor-reactive CTLs have concerned cancers (Boon, T. et al., Ann. Rev. Immunol., 12:337-365, (1994)). The ability of tumor-specific CTLs to mediate tumor regression, in both human (Rosenberg, S. A. et al., N. Engl. J. Med., 319: 1676-1680, (1988)) and animal models (Celluzzi, C. M. et al., J. Exp. Med., 183:283-287, (1996); Mayordomo, J. I. et al., Nat. Med., 1:1297-1302, (1995); Zitvogel, L. et al., J. Exp. Med., 183:87-97, (1996)), suggests that methods directed at increasing CTL activity would likely have a beneficial effect with respect to tumor treatment.

In order for CTLs to kill or secrete cytokines in response to a cancer cell, the CTL must first recognize that cell as being cancerous. This process involves the interaction of the T cell receptor, located on the surface of the CTL, with what is generically referred to as an MHC-peptide complex which is located on the surface of the cancerous cell. MHC (major histocompatibility-complex)-encoded molecules have been subdivided into two types, and are referred to as class I and class II MHC-encoded molecules.

In the human immune system, MHC molecules are referred to as human leukocyte antigens (HLA). Within the MHC, located on chromosome six, are three different genetic loci that encode for class I MHC molecules. MHC molecules encoded at these loci are referred to as HLA-A, HLA-B, and HLA-C. The genes that can be encoded at each of these loci are extremely polymorphic, and thus, different individuals within the population express different class I MHC molecules on the surface of their cells. HLA-A1, HLA-A2, HLA-A3, HLA-B7, and HLA-B8 are examples of different class I MHC molecules that can be expressed from these loci. The present disclosure involves peptides that are associated with the HLA-A1, HLA-A2, or HLA-A11 molecules, HLA-A1 supertypes, HLA-A2 supertypes, and HLA-A11 supertypes and with the gene and protein that gives rise to these peptides. A supertype is a group of HLA molecules that present at least one shared epitope.

The peptides that associate with the MHC molecules can either be derived from proteins made within the cell, in which case they typically associate with class I MHC molecules (Rock, K. L. and Golde, U., Ann. Rev. Immunol., 17:739-779, (1999)) or they can be derived from proteins that are acquired from outside of the cell, in which case they typically associate with class II MHC molecules (Watts, C., Ann. Rev. Immunol., 15:821-850, (1997)). Peptides that evoke a cancer-specific CTL response most typically associate with class I MHC molecules. The peptides that associate with a class I MHC molecule are typically nine amino acids in length, but can vary from a minimum length of eight amino acids to a maximum of fourteen amino acids in length. A class I MHC molecule with its bound peptide, or a class II MHC molecule with its bound peptide, is referred to as an MHC-peptide complex.

The process by which intact proteins are degraded into peptides is referred to as antigen processing. Two major pathways of antigen processing occur within cells (Rock, K. L. and Golde, U., Ann. Rev. Immunol., 17:739-779, (1999); Watts, C., Ann. Rev. Immunol., 15:821-850, (1997)). One pathway, which is largely restricted to cells that are antigen presenting cells such as dendritic cells, macrophages, and B cells, degrades proteins that are typically phagocytosed or endocytosed into the cell. Peptides derived in this pathway typically bind to class II MHC molecules. A second pathway of antigen processing is present in essentially all cells of the body. This second pathway primarily degrades proteins that are made within the cells, and the peptides derived from this pathway primarily bind to class I MHC molecules. It is the peptides from this second pathway of antigen processing that are referred to herein. Antigen processing by this latter pathway involves polypeptide synthesis and proteolysis in the cytoplasm. The peptides produced are then transported into the endoplasmic reticulum of the cell, associate with newly synthesized class I MHC molecules, and the resulting MHC-peptide complexes are then transported to the cell surface. Peptides derived from membrane and secreted proteins have also been identified. In some cases these peptides correspond to the signal sequence of the proteins that are cleaved from the protein by the signal peptidase. In other cases, it is thought that some fraction of the membrane and secreted proteins are transported from the endoplasmic reticulum into the cytoplasm where processing subsequently occurs.

Once bound to the class I MHC molecule and displayed on the surface of a cell, the peptides are recognized by antigen-specific receptors on CTLs. Mere expression of the class I MHC molecule itself is insufficient to trigger the CTL to kill the target cell if the antigenic peptide is not bound to the class I MHC molecule. Several methods have been developed to identify the peptides recognized by CTL, each method relying on the ability of a CTL to recognize and kill only those cells expressing the appropriate class I MHC molecule with the peptide bound to it (Rosenberg, S. A., Immunity, 10:281-287, (1999)). Such peptides can be derived from a non-self source, such as a pathogen (for example, following the infection of a cell by a bacterium or a virus) or from a self-derived protein within a cell, such as a cancerous cell. Examples of sources of self-derived proteins in cancerous cells have been reviewed (Gilboa, E., Immunity, 11:263-270, (1999); Rosenberg, S. A., Immunity, 10:281-287, (1999)) and include: (i) mutated genes; (ii) aberrantly expressed genes such as an alternative open reading frame or through an intron-exon boundary; (iii) normal genes that are selectively expressed in only the tumor and the testis; and (iv) normal differentiation genes that are expressed in the tumor and the normal cellular counterpart.

Four different methodologies have typically been used for identifying the peptides that are recognized by CTLs. These are: (i) the genetic method; (2) motif analysis; (3) SErological analysis of REcombinant cDNA expression libraries (SEREX™); and (iv) the analytical chemistry approach or the Direct Identification of Relevant Epitopes for Clinical Therapeutics (DIRECT™).

The genetic method is an approach in which progressively smaller subsets of cDNA libraries from tumor cells are transfected into cells that express the appropriate MHC molecule but not the tumor-specific epitope. The molecular clones encoding T cell epitopes are identified by their ability to reconstitute tumor specific T cell recognition of transfected cells. The exact T cell epitope is then identified by a combination of molecular subcloning and the use of synthetic peptides based on the predicted amino acid sequence. Such methods, however, are susceptible to inadvertent identification of cross-reacting peptides, and are not capable of identifying important post-translational modifications.

Motif analysis involves scanning a protein for peptides containing known class I MHC binding motifs, followed by synthesis and assay of the predicted peptides for their ability to be recognized by tumor-specific CTL. This approach requires prior knowledge of the protein from which the peptides are derived. This approach is also greatly hampered by the fact that not all of the predicted peptide epitopes are presented on the surface of a cell (Yewdell, J. W. and Bennink, J. R., Ann. Rev. Immunol., 17:51-88, (1999)), thus additional experimentation is required to determine which of the predicted epitopes is useful.

The SEREX™ approach relies on using antibodies in the serum of cancer patients to screen cDNA expression libraries for a clone that expresses a protein recognized by the antibody. This methodology presumes that an antibody response will necessarily have developed in the presence of a T cell response, and thus, the identified clone is good candidate to encode a protein that can be recognized by T cells.

DIRECT™ involves a combination of cellular immunology and mass spectrometry. This approach involves the actual identification of CTL epitopes by sequencing the naturally occurring peptides associated with class I MHC molecules. In this approach, cells are first lysed in a detergent solution, the peptides associated with the class I MHC molecules are purified, and the peptides fractionated by high performance liquid chromatography (HPLC). The peptides are then used to reconstitute recognition by tumor-specific CTLs on a non-tumor cell expressing the appropriate MHC molecules. Sequencing is readily performed by tandem mass spectrometry (Henderson, R. A. et al., Proc. Natl. Acad. Sci. U.S.A, 90:10275-10279, (1993); Hogan, K. T. et al., Cancer Res., 58:5144-5150, (1998); Hunt, D. F. et al., Science, 255:1261-1263, (1992); Slingluff, C. L. Jr et al., J. Immunol., 150:2955-2963, (1993)).

Immunization with cancer-derived, class I MHC-encoded molecule-associated peptides, or with a precursor polypeptide or protein that contains the peptide, or with a gene that encodes a polypeptide or protein containing the peptide, are forms of immunotherapy that can be employed in the treatment of cancer. These forms of immunotherapy require that immunogens be identified so that they can be formulated into an appropriate vaccine. Although a variety of cancer-derived antigens have been identified (Rosenberg, S. A., Immunity, 10:281-287, (1999)), not all of these are appropriate for broad-based immunotherapy as the expression of some peptides is limited to the tumor derived from a specific patient. Furthermore, the number of class I MHC molecules from which tumor-derived peptides have been discovered is largely restricted to HLA-A2. Thus, it would be useful to identify additional peptides that complex with class I MHC molecules other than HLA-A2. Such peptides would be particularly useful in the treatment of cancer patients who do not express the HLA-A2 molecule, HLA-A1 or HLA-A11 antigens, HLA-A1 supertypes, HLA-A2 supertypes and HLA-A11 supertypes, for example. It is also particularly useful to identify antigenic peptides that are derived from different original proteins, even if the derived peptides associate with the same class I MHC molecule. Because an active immune response can result in the outgrowth of tumor cells that have lost the expression of a particular precursor protein for a given antigenic peptide, it is advantageous to stimulate an immune response against peptides derived from more than one protein, as the chances of the tumor cell losing the expression of both proteins is the multiple of the chances of losing each of the individual proteins.

SUMMARY OF THE INVENTION

The present invention relates to Immunogens comprising polypeptides with amino acid sequences comprising epitopic sequences selected from the sequences of SEQ ID NO: 1-791 and 1514-1533 and which immunogens facilitate a cytotoxic T lymphocyte (CTL)-mediated immune response against cancers. The present invention also relates to nucleic acid molecules that encode for the polypeptides and/or the full length proteins from which the polypeptides are derived, of such immunogens, and which can also be used to facilitate an immune response against cancer.

The present invention provides compositions comprising the immunogen described herein, and polynucleotides that direct the synthesis of such polypeptides, whereby the oligopeptides and polypeptides of such immunogens are capable of inducing a CTL response against cells expressing a protein comprising an epitopic sequence of at least one of SEQ ID NO: 1-791 and 1514-1533. The cells are usually cancer cells, preferably carcinoma cells, most preferably ovarian carcinomas expressing such proteins.

The present invention further relates to polynucleotides comprising the gene coding for a polypeptide of the immunogens disclosed herein.

The present invention also provides methods that comprise contacting a lymphocyte, especially a CTL, with an immunogen of the invention under conditions that induce a CTL response against a tumor cell, and more specifically against a cancer cell. The methods may involve contacting the CTL with the immunogenic peptide in vivo, in which case the peptides, polypeptides, and polynucleotides of the invention are used as vaccines, and will be delivered as a pharmaceutical composition comprising a pharmaceutically acceptable carrier and the immunogen, typically along with an adjuvant or one or more cytokines.

Alternatively, the immunogens of the present invention can be used to induce a CTL response in vitro. The generated CTL can then be introduced into a patient with cancer, more specifically cancer, colorectal carcinoma, ovarian carcinoma, breast carcinoma, lung carcinoma, or prostate carcinoma. Alternatively, the ability to generate CTL in vitro could serve as a diagnostic for cancer generally, including colorectal carcinoma, ovarian carcinoma, breast carcinoma, lung carcinoma, or prostate carcinoma.

DETAILED DESCRIPTION OF THE INVENTION

Definitions

As used herein and except as noted otherwise, all terms are defined as given below.

The term "peptide" is used herein to designate a series of amino acid residues, connected one to the other typically by peptide bonds between the alpha-amino and carbonyl groups of the adjacent amino acids. The peptides are typically 9 amino acids in length, but can be as short as 8 amino acids in length, and as long as 14 amino acids in length.

The term "oligopeptide" is used herein to designate a series of amino acid residues, connected one to the other typically by peptide bonds between the alpha-amino and carbonyl groups of the adjacent amino acids. The length of the oligopeptide is not critical to the invention as long as the correct epitope or epitopes are maintained therein. The oligopeptides are typically less than about 30 amino acid residues in length, and greater than about 14 amino acids in length.

A peptide, oligopeptide, protein, or polynucleotide coding for such a molecule is "immunogenic" (and thus an "immunogen" within the present invention) if it is capable of inducing an immune response. In the case of the present invention, immunogenicity is more specifically defined as the ability to induce a CTL-mediated response. Thus, an "immunogen" would be a molecule that is capable of inducing an immune response, and in the case of the present invention, a molecule capable of inducing a CTL response.

A T cell "epitope" is a short peptide molecule that binds to a class I or II MHC molecule and that is subsequently recognized by a T cell. T cell epitopes that bind to class I MHC molecules are typically 8-14 amino acids in length, and most typically 9 amino acids in length. T cell epitopes that bind to class II MHC molecules are typically 12-20 amino acids in length. In the case of epitopes that bind to class II MHC molecules, the same T cell epitope may share a common core segment, but differ in the length of the carboxy- and amino-terminal flanking sequences due to the fact that ends of the peptide molecule are not buried in the structure of the class II MHC molecule peptide-binding cleft as they are in the class I MHC molecule peptide-binding cleft.

There are three different genetic loci that encode for class I MHC molecules: HLA-A, HLA-B, and HLA-C. HLA-A1, HLA-A2, and HLA-A11 are examples of different class I MHC molecules that can be expressed from these loci. The present invention also involves peptides that are associated with HLA-A1 supertypes, HLA-A2 supertypes, and HLA-A11 supertypes. A supertype is a group of HLA molecules that present at least one shared epitope. MHC molecule peptides that have been found to bind to one member of the MHC allele supertype family (A1 for example) are thought to be likely to bind to other members of the same supertype family (A32 for example; see Table 1, below.

TABLE 1

| Supertype | Motif | Genotypes |
|---|---|---|
| A1 | x[TI(SVLM)]<br>xxxxxx[WFY] | A*0101, A*0102, A*2501, A*2601, A*2604,<br>A*3201, A*3601, A*4301, A*8001 |
| A2 | x[LIVMATQ]<br>xxxxxx[LIVMAT] | A*0201, A*0202, A*0203, A*0204, A*0205,<br>A*0206, A*0207, A*6802, A*6901 |
| A3 | x[AILMVST]<br>xxxxxx[RK] | A*0301, A*1101, A*3101, A*3301, A*6801 |
| A24 | x[YF(WIVLMT)]<br>xxxxxx[FI(YWLM)] | A*2301, A*2402, A*2403, A*2404, A*3001,<br>A*3002, A*3003 |
| B7 | x[P]xxxxxx<br>[ALIMVFWY] | B*0702, B*0703, B*0704, B*0705, B*1508, B*3501,<br>B*3502, B*3503, B*51, B*5301, B*5401, B*5501,<br>B*5502, B*5601, B*5602, B*6701, B*7801 |
| B27 | x[RKH]xxxxxx<br>[FLY(WMI)] | B*1401, B*1402, B*1503, B*1509, B*1510, B*1518,<br>B*2701, B*2702, B*2703, B*2704, B*2705, B*2706,<br>B*2707, B*2708, B*3801, B*3802, B*3901, B*3902,<br>B*3903, B*3904, B*4801, B*4802, B*7301 |
| B44 | x[E(D)]xxxxxx<br>[FWYLIMVA] | B*18, B*3701, B*4001, B*4006, B*4101, B*4402,<br>B*4403, B*4501, B*4901, B*5001 |
| B58 | x[AST]xxxxxx<br>[FWY(LIV)] | B*1516, B*1517, B*5701, B*5702, B*58 |
| B62 | x[QL(IVMP)]<br>xxxxxx[FWY(MIV)] | B*1301, B*1302, B*1501, B*1502, B*1506, B*1512,<br>B*1513, B*1514, B*1519, B*1521, B*4601, B*52 |

The term "polypeptide" designates a series of amino acid residues, connected one to the other typically by peptide bonds between the alpha-amino and carbonyl groups of the adjacent amino acids. The length of the polypeptide is not critical to the invention as long as the correct epitopes are maintained. In contrast to the terms peptide or oligopeptide, the term polypeptide is meant to refer to protein molecules of longer than about 30 residues in length.

As used herein, reference to a DNA sequence includes both single stranded and double stranded DNA. Thus, the specific sequence, unless the context indicates otherwise, refers to the single strand DNA of such sequence, the duplex of such sequence with its complement (double stranded DNA) and the complement of such sequence.

The term "coding region" refers to that portion of a gene which either naturally or normally codes for the expression product of that gene in its natural genomic environment, i.e., the region coding in vivo for the native expression product of the gene. The coding region can be from a normal, mutated or altered gene, or can even be from a DNA sequence, or gene, wholly synthesized in the laboratory using methods well known to those of skill in the art of DNA synthesis.

The term "nucleotide sequence" refers to a heteropolymer of deoxyribonucleotides. The nucleotide sequence encoding for a particular peptide, oligopeptide, or polypeptide may be naturally occurring or they may be synthetically constructed. Generally, DNA segments encoding the peptides, polypeptides, and proteins of this invention are assembled from cDNA fragments and short oligonucleotide linkers, or from a series of oligonucleotides, to provide a synthetic gene which is capable of being expressed in a recombinant transcriptional unit comprising regulatory elements derived from a microbial or viral operon.

The term "expression product" means that polypeptide or protein that is the natural translation product of the gene and any nucleic acid sequence coding equivalents resulting from genetic code degeneracy and thus coding for the same amino acid(s).

The term "fragment," when referring to a coding sequence, means a portion of DNA comprising less than the complete coding region whose expression product retains essentially the same biological function or activity as the expression product of the complete coding region.

The term "DNA segment" refers to a DNA polymer, in the form of a separate fragment or as a component of a larger DNA construct, which has been derived from DNA isolated at least once in substantially pure form, i.e., free of contaminating endogenous materials and in a quantity or concentration enabling identification, manipulation, and recovery of the segment and its component nucleotide sequences by standard biochemical methods, for example, by using a cloning vector. Such segments are provided in the form of an open reading frame uninterrupted by internal nontranslated sequences, or introns, which are typically present in eukaryotic genes. Sequences of non-translated DNA may be present downstream from the open reading frame, where the same do not interfere with manipulation or expression of the coding regions.

The term "primer" means a short nucleic acid sequence that is paired with one strand of DNA and provides a free 3'OH end at which a DNA polymerase starts synthesis of a deoxyribonucleotide chain.

The term "promoter" means a region of DNA involved in binding of RNA polymerase to initiate transcription.

The term "open reading frame (ORF)" means a series of triplets coding for amino acids without any termination codons and is a sequence (potentially) translatable into protein.

The term "isolated" means that the material is removed from its original environment (e.g., the natural environment if it is naturally occurring). For example, a naturally-occurring polynucleotide or polypeptide present in a living animal is not isolated, but the same polynucleotide or polypeptide, separated from some or all of the coexisting materials in the natural system, is isolated. Such polynucleotides could be part of a vector and/or such polynucleotides or polypeptides could be part of a composition, and still be isolated in that such vector or composition is not part of its natural environment.

The polynucleotides, and recombinant or immunogenic polypeptides, disclosed in accordance with the present invention may also be in "purified" form. The term "purified" does not require absolute purity; rather, it is intended as a relative definition, and can include preparations that are highly purified or preparations that are only partially purified, as those terms are understood by those of skill in the relevant art. For example, individual clones isolated from a cDNA library have been conventionally purified to electrophoretic homogeneity. Purification of starting material or natural material to at least one order of magnitude, preferably two or three orders, and more preferably four or five orders of magnitude is expressly contemplated. Furthermore, the claimed polypeptide which has a purity of preferably 0.001%, or at least 0.01% or 0.1%; and even desirably 1% by weight or greater is expressly contemplated.

The nucleic acids and polypeptide expression products disclosed according to the present invention, as well as expression vectors containing such nucleic acids and/or such polypeptides, may be in "enriched form." As used herein, the term "enriched" means that the concentration of the material is at least about 2, 5, 10, 100, or 1000 times its natural concentration (for example), advantageously 0.01%, by weight, preferably at least about 0.1% by weight. Enriched preparations of about 0.5%, 1%, 5%, 10%, and 20% by weight are also contemplated. The sequences, constructs, vectors, clones, and other materials comprising the present invention can advantageously be in enriched or isolated form.

The term "active fragment" means a fragment that generates an immune response (i.e., has immunogenic activity) when administered, alone or optionally with a suitable adjuvant, to an animal, such as a mammal, for example, a rabbit or a mouse, and also including a human, such immune response taking the form of stimulating a CTL response within the recipient animal, such as a human. Alternatively, the "active fragment" may also be used to induce a CTL response in vitro.

As used herein, the terms "portion," "segment," and "fragment," when used in relation to polypeptides, refer to a continuous sequence of residues, such as amino acid residues, which sequence forms a subset of a larger sequence. For example, if a polypeptide were subjected to treatment with any of the common endopeptidases, such as trypsin or chymotrypsin, the oligopeptides resulting from such treatment would represent portions, segments or fragments of the starting polypeptide. This means that any such fragment will necessarily contain as part of its amino acid sequence a segment, fragment or portion, that is substantially identical, if not exactly identical, to a sequence of SEQ ID NO: 792-1513, which correspond to the naturally occurring, or "parent" proteins of the SEQ ID NO: 1-791 and 1514-1533. When used in relation to polynucleotides, such terms refer to the products produced by treatment of said polynucleotides with any of the common endonucleases.

In accordance with the present invention, the term "percent identity" or "percent identical," when referring to a sequence, means that a sequence is compared to a claimed or described sequence after alignment of the sequence to be compared (the "Compared Sequence") with the described or claimed sequence (the "Reference Sequence"). The Percent Identity is then determined according to the following formula:

Percent Identity=$100[1-(C/R)]$ wherein C is the number of differences between the Reference Sequence and the Compared Sequence over the length of alignment between the Reference Sequence and the Compared Sequence wherein (i) each base or amino acid in the Reference Sequence that does not have a corresponding aligned base or amino acid in the Compared Sequence and (ii) each gap in the Reference Sequence and (iii) each aligned base or amino acid in the Reference Sequence that is different from an aligned base or amino acid in the Compared Sequence, constitutes a difference; and R is the number of bases or amino acids in the Reference Sequence over the length of the alignment with the Compared Sequence with any gap created in the Reference Sequence also being counted as a base or amino acid.

If an alignment exists between the Compared Sequence and the Reference Sequence for which the percent identity as calculated above is about equal to or greater than a specified minimum Percent Identity then the Compared Sequence has the specified minimum percent identity to the Reference Sequence even though alignments may exist in which the herein above calculated Percent Identity is less than the specified Percent Identity.

The present invention relates generally to immunogens and immunogenic compositions, and methods of use therefore, for the prevention, treatment, and diagnosis of cancer, especially carcinomas, including ovarian carcinomas. Disclosed according to the invention are immunogens comprising proteins or polypeptides whose amino acid sequences comprises one or more epitopic oligopeptides with sequences selected from the group SEQ ID NO: 1-791 and 1514-1533. In addition, the invention further relates to polynucleotides that can be used to stimulate a CTL response against cancer, and more specifically carcinoma, especially ovarian carcinomas.

In accordance with the present invention there are disclosed specific oligopeptide sequences with amino acid sequences shown in SEQ ID NO: 1-791 and 1514-1533, which represent epitopic peptides (i.e. immunogenic oligopeptide sequences) of at least about 8 amino acids in length, preferably about 9 amino acids in length (i.e., nonapeptides), and no longer than about 10 amino acids in length and present as part of a larger structure, such as a polypeptide or full length protein.

The polypeptides forming the immunogens of the present invention have amino acid sequences that comprise at least one stretch, possibly two, three, four, or more stretches of about 8 to 10 residues in length and which stretches differ in amino acid sequence from the sequences of SEQ ID NO: 1-791 and 1514-1533 by no more than about 1 amino acid residue, preferably a conservative amino acid residue, especially amino acids of the same general chemical character, such as where they are hydrophobic amino acids.

Said polypeptides can be of any desired length so long as they have immunogenic activity in that they are able, under a given set of desirable conditions, to elicit in vitro or in vivo the activation of cytotoxic T lymphocytes (CTLs) (i.e., a CTL response) against a presentation of a cancer specific protein, especially a carcinoma or sarcoma specific protein, most especially MAGE D, MAGE 4, MFG-E8 or human retinoblastoma-like protein, especially when such proteins are presented along with MHC-1 proteins, such as where said proteins are presented in vitro or in vivo by an antigen presenting cell (APC). The proteins and polypeptides forming the immunogens of the present invention can be naturally occurring or may be synthesized chemically. According to the present invention the polypeptides may comprise at least one of SEQ ID NO: 792-1513.

The present invention is also directed to an isolated polypeptide, especially one having immunogenic activity, the sequence of which comprises within it one or more stretches comprising any 2 or more of the sequences of SEQ ID NO: 1-791 and 1514-1533 and in any relative quantities and wherein said sequences may differ by one amino acid residues from the sequences of SEQ ID NO: 1-791 and 1514-1533 in any given stretch of 8 to 10 amino acid residues. Thus, within the present invention, by way of a non-limiting example only, such polypeptide may contain as part of its amino acid sequence, nonapeptide fragments having up to 8 amino acids identical to a sequence of SEQ ID NO: 1-4 such that the polypeptide comprises, in a specific embodiment, 2 segments with at least 8 residues identical to SEQ ID NO: 1 and one segment with at least 8 residues identical to SEQ ID NO: 3. In other embodiments, other combinations and permutations of the epitopic sequences disclosed herein may be part of an immunogen of the present invention or of such a polypeptide so long as any such polypeptide comprises at least 2 such epitopes, whether such epitopes are different or the same. Thus, in a specific embodiment, a polypeptide of the present invention may comprise 2 copies of the sequence of SEQ ID NO: 2 at some point or points within its length. Of course, any combinations and permutations of the epitopes disclosed herein, as long as they are present at least two in number in such polypeptides, are expressly contemplated.

All of the epitopic peptides of SEQ ID NO: 1-791 and 1514-1533 are derived from proteins expressed by cancer cells and sequences and were identified through the method of Automated High Through-put Sequencing (HTPS). Accordingly, SEQ ID NO: 792-1513 are polypeptides that comprise at least one of SEQ ID NO: 1-791 and 1514-1533.

Oligopeptides as disclosed herein may themselves be prepared by methods well known to those skilled in the art. (Grant, G. A., Synthetic Peptides: A User's Guide, 1992, W. H. Freeman and Company, New York; Coligan, J. E. et al, Current Protocols in Protein Science, 1999, John Wiley & Sons, Inc., New York).

Besides the sequences of SEQ ID NO:1-791 and 1514-1533, the proteins and polypeptides forming the immunogens of the present invention may also comprise one or more other immunogenic amino acid stretches known to be associated with cancer, and more specifically with carcinomas and melanomas, including colorectal carcinoma, ovarian carcinoma, breast carcinoma, lung carcinoma, or prostate carcinoma, and which may stimulate a CTL response whereby the immunogenic peptides associate with HLA-A1 or HLA-A11, or HLA-A2, or another class I MHC (i.e., MHC-1) molecule.

The immunogens of the present invention can be in the form of a composition of one or more of the different immunogens and wherein each immunogen is present in any desired relative abundance. Such compositions can be homogeneous or heterogeneous with respect to the individual immunogenic peptide components present therein, having only one or more than one of such peptides.

The oligopeptides and polypeptides useful in practicing the present invention may be derived by fractionation of naturally occurring proteins by methods such as protease treatment, or they may be produced by recombinant or synthetic methodologies that are well known and clear to the skilled artisan (Ausubel, F. M. et al, Current Protocols in Molecular Biology, 1999, John Wiley & Sons, Inc., New York; Coligan, J. E. et al, Current Protocols in Protein Science, 1999, John Wiley & Sons, Inc., New York; Molecular Cloning: A Laboratory Manual, 1989, Cold Spring Harbor Laboratory Press, Cold Spring Harbor). The polypeptide may comprise a recombinant or synthetic polypeptide that comprises at least one of SEQ ID NO: 1-791 and 1514-1533 which sequences may also be present in multiple copies. Thus, oligopeptides and polypeptides of the present invention may have one, two, three, or more such immunogenic peptides within the amino acid sequence of said oligopeptides and polypeptides, and said immunogenic peptides, or epitopes, may be the same or may be different, or may have any number of such sequences wherein some of them are identical to each other in amino acid sequence while others within the same polypeptide sequence are different from each other and said epitopic sequences may occur in any order within said immunogenic polypeptide sequence. The location of such sequences within the sequence of a polypeptide forming an immunogen of the invention may affect relative immunogenic activity. In addition, immunogens of the present invention may comprise more than one protein comprising the amino acid sequences disclosed herein. Such polypeptides may be part of a single composition or may themselves be covalently or non-covalently linked to each other.

The immunogenic peptides disclosed herein may also be linked directly to, or through a spacer or linker to: an immunogenic carrier such as serum albumin, tetanus toxoid, keyhole limpet hemocyanin, dextran, or a recombinant virus particle; an immunogenic peptide known to stimulate a T helper cell type immune response; a cytokine such as interferon gamma or GMCSF; a targeting agent such as an antibody or receptor ligand; a stabilizing agent such as a lipid; or a conjugate of a plurality of epitopes to a branched lysine core structure, such as the so-called "multiple antigenic peptide" described in (Posneft, D. N. et al., J. Biol. Chem., 263:1719-1725, (1988)); a compound such as polyethylene glycol to increase the half life of the peptide; or additional amino acids such as a leader or secretory sequence, or a sequence employed for the purification of the mature sequence. Spacers and linkers are typically comprised of relatively small, neutral molecules, such as amino acids and which are substantially uncharged under physiological conditions. Such spacers are typically selected from the group of nonpolar or neutral polar amino acids, such as glycine, alanine, serine and other similar amino acids. Such optional spacers or linkers need not be comprised of the same residues and thus may be either homo- or hetero-oligomers. When present, such linkers will commonly be of length at least one or two, commonly 3, 4, 5, 6, and possibly as much as 10 or even up to 20 residues (in the case of amino acids). In addition, such linkers need not be composed of amino acids but any oligomeric structures will do as well so long as they provide the correct spacing so as to optimize the desired level of immunogenic activity of the immunogens of the present invention. The immunogen may therefore take any form that is capable of eliciting a CTL response.

In addition, the immunogenic peptides of the present invention may be part of an immunogenic structure via attachments other than conventional peptide bonds. Thus, any manner of attaching the peptides of the invention to an immunogen of the invention, such as an immunogenic polypeptide as disclosed herein, could provide an immunogenic structure as claimed herein. Thus, immunogens, such as proteins of the invention, are structures that contain the peptides disclosed according to the present invention but such immunogenic peptides may not necessarily be attached thereto by the conventional means of using ordinary peptide bounds. The immunogens of the present invention simply contain such peptides as part of their makeup, but how such peptides are to be combined to form the final immunogen is left to the talent and imagination of the user and is in no way restricted or limited by the disclosure contained herein.

The peptides that are naturally processed and bound to a class I MHC molecule, and which are recognized by a tumor-specific CTL, need not be the optimal peptides for stimulating a CTL response. See, for example, (Parkhurst, M. R. et al., J. Immunol., 157:2539-2548, (1996); Rosenberg, S. A. et al., Nat. Med., 4:321-327, (1998)). Thus, there can be utility in modifying a peptide, such that it more readily induces a CTL response. Generally, peptides may be modified at two types of positions. The peptides may be modified at amino acid residues that are predicted to interact with the class I MHC molecule, in which case the goal is to create a peptide that has a higher affinity for the class I MHC molecule than does the original peptide. The peptides can also be modified at amino acid residues that are predicted to interact with the T cell receptor on the CTL, in which case the goal is to create a peptide that has a higher affinity for the T cell receptor than does the original peptide. Both of these types of modifications can result in a variant peptide that is related to an original peptide, but which is better able to induce a CTL response than is the original peptide. As used herein, the term "original peptide" means an oligopeptide with the amino acid sequence selected from SEQ ID NO: 1-791 and 1514-1533.

The original peptides disclosed herein can be modified by the substitution of one or more residues at different, possibly selective, sites within the peptide chain. Such substitutions may be of a conservative nature, for example, where one amino acid is replaced by an amino acid of similar structure and characteristics, such as where a hydrophobic amino acid is replaced by another hydrophobic amino acid. Even more conservative would be replacement of amino acids of the same or similar size and chemical nature, such as where leucine is replaced by isoleucine. In studies of sequence variations in families of naturally occurring homologous proteins, certain amino acid substitutions are more often tolerated than others, and these are often show correlation with similarities in size, charge, polarity, and hydrophobicity between the original amino acid and its replacement, and such is the basis for defining "conservative substitutions."

Conservative substitutions are herein defined as exchanges within one of the following five groups: Group 1—small aliphatic, nonpolar or slightly polar residues (Ala, Ser, Thr, Pro, Gly); Group 2—polar, negatively charged residues and their amides (Asp, Asn, Glu, Gln); Group 3—polar, positively charged residues (His, Arg, Lys); Group 4—large, aliphatic, nonpolar residues (Met, Leu, lie, Val, Cys); and Group 4—large, aromatic residues (Phe, Tyr, Trp).

Less conservative substitutions might involve the replacement of one amino acid by another that has similar characteristics but is somewhat different in size, such as replacement of an alanine by an isoleucine residue. Highly nonconservative replacements might involve substituting an acidic amino acid for one that is polar, or even for one that is basic in character. Such radical substitutions cannot, however, be dismissed as potentially ineffective since chemical effects are not totally predictable and radical substitutions might well give rise to serendipitous effects not otherwise predictable from simple chemical principles.

Of course, such substitutions may involve structures other than the common L-amino acids. Thus, D-amino acids might be substituted for the L-amino acids commonly found in the antigenic peptides of the invention and yet still be encompassed by the disclosure herein. In addition, amino acids possessing non-standard R groups (i.e., R groups other than those found in the common 20 amino acids of natural proteins) may also be used for substitution purposes to produce immunogens and immunogenic polypeptides according to the present invention.

If substitutions at more than one position are found to result in a peptide with substantially equivalent or greater antigenic activity as defined below, then combinations of those substitutions will be tested to determine if the combined substitutions result in additive or syngeneic effects on the antigenicity of the peptide. At most, no more than 4 positions within the peptide would simultaneously be substituted.

Based on cytotoxicity assays, an epitope is considered substantially identical to the reference peptide if it has at least 10% of the antigenic activity of the reference peptide as defined by the ability of the substituted peptide to reconstitute the epitope recognized by a CTL in comparison to the reference peptide. Thus, when comparing the lytic activity in the linear portion of the effector:target curves with equimolar concentrations of the reference and substituted peptides, the observed percent specific killing of the target cells incubated with the substituted peptide should be equal to that of the reference peptide at an effector:target ratio that is no greater than 10-fold above the reference peptide effector:target ratio at which the comparison is being made.

Preferably, when the CTLs specific for a peptide of SEQ ID NO: 1-791 and 1514-1533 are tested against the substituted peptides, the peptide concentration at which the substituted peptides achieve half the maximal increase in lysis relative to background is no more than about 1 mM, preferably no more than about 1 µM, more preferably no more than about 1 nM, and still more preferably no more than about 100 pM, and most preferably no more than about 10 pM. It is also preferred that the substituted peptide be recognized by CTLs from more than one individual, at least two, and more preferably three individuals.

Thus, the epitopes of the present invention may be identical to naturally occurring tumor-associated or tumor-specific epitopes or may include epitopes that differ by no more than 4 residues from the reference peptide, as long as they have substantially identical antigenic activity.

It should be appreciated that an immunogen may consist only of a peptide of SEQ ID NO:1-791 or 1514-1533, or comprise a peptide of SEQ ID NO:1-791 or 1514-1533, or comprise a plurality of peptides selected from SEQ ID NO:1-791 and 1514-1533, or comprise a polypeptide that itself comprises one or more of the epitopic peptides of SEQ ID NO: 1-791 and 1514-1533.

The immunogenic peptides and polypeptides of the invention can be prepared synthetically, by recombinant DNA technology, or they can be isolated from natural sources such as tumor cells expressing the original protein product.

The polypeptides and oligopeptides disclosed herein can be synthesized in solution or on a solid support in accordance with conventional techniques. Various automated peptide synthesizers are commercially available and can be used in accordance with known protocols. See, for example, (Grant, G. A., Synthetic Peptides: A User's Guide, 1992, W. H. Freeman and Company, New York; Coligan, J. E. et al, Current Protocols in Protein Science, 1999, John Wiley & Sons, Inc., New York). Fragments of polypeptides of the invention can also be synthesized as intermediates in the synthesis of a larger polypeptide.

Recombinant DNA technology may be employed wherein a nucleotide sequence which encodes an immunogenic peptide or polypeptide of interest is inserted into an expression vector, transformed or transfected into an appropriate host cell, and cultivated under conditions suitable for expression. These procedures are well known in the art to the skilled artisan, as described in (Coligan, J. E. et al, Current Protocols in Immunology, 1999, John Wiley & Sons, Inc., New York; Ausubel, F. M. et al, Current Protocols in Molecular Biology, 1999, John Wiley & Sons, Inc., New York; Molecular Cloning: A Laboratory Manual, 1989, Cold Spring Harbor Laboratory Press, Cold Spring Harbor). Thus, recombinantly produced peptides or polypeptides can be used as the immunogens of the invention.

The coding sequences for peptides of the length contemplated herein can be synthesized on commercially available automated DNA synthesizers using protocols that are well know in the art. See for example, (Grant, G. A., Synthetic Peptides: A User's Guide, 1992, W. H. Freeman and Company, New York; Coligan, J. E. et al, Current Protocols in Protein Science, 1999, John Wiley & Sons, Inc., New York). The coding sequences can also be modified such that a peptide or polypeptide will be produced that incorporates a desired amino acid substitution. The coding sequence can be provided with appropriate linkers, be ligated into suitable expression vectors that are commonly available in the art, and the resulting DNA or RNA molecule can be transformed or transfected into suitable hosts to produce the desired fusion protein. A number of such vectors and suitable host systems are available, and their selection is left to the skilled artisan. For expression of the fusion proteins, the coding sequence will be provided with operably linked start and stop codons, promoter and terminator regions, and a replication system to provide an expression vector for expression in the desired host cell. For example, promoter sequences compatible with bacterial hosts are provided in plasmids containing convenient restriction sites for insertion of the desired coding sequence. The resulting expression vectors are transformed into suitable bacterial hosts. Of course, yeast, insect, and mammalian host cells may also be used, employing suitable vectors and control sequences.

Host cells are genetically engineered (transduced or transformed or transfected) with the vectors of this invention which may be, for example, a cloning vector or an expression vector. The vector may be, for example, in the form of a plasmid, a viral particle, a phage, etc. The engineered host cells can be cultured in conventional nutrient media modified as appropriate for activating promoters, selecting transformants or amplifying the genes of the present invention. The culture conditions, such as temperature, pH and the like, are those previously used with the host cell selected for expression, and will be apparent to the ordinarily skilled artisan.

More particularly, the present invention also includes recombinant constructs comprising one or more of the sequences as broadly described above. The constructs comprise a vector, such as a plasmid or viral vector, into which a sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available.

In a further embodiment, the present invention relates to host cells containing the above-described constructs. The host cell can be a higher eukaryotic cell, such as a mammalian cell, or a lower eukaryotic cell, such as a yeast cell, or the host cell can be a prokaryotic cell, such as a bacterial cell. Introduction of the construct into the host cell can be effected by calcium phosphate transfection, DEAE-Dextran mediated transfection, or electroporation (Ausubel, F. M. et al, Current Protocols in Molecular Biology, 1999, John Wiley & Sons, Inc., New York; Molecular Cloning: A Laboratory Manual, 1989, Cold Spring Harbor Laboratory Press, Cold Spring Harbor). Such cells can routinely be utilized for assaying CTL activity by having said genetically engineered, or recombinant, host cells express the immunogenic peptides of the present invention.

Various mammalian cell culture systems can also be employed to express recombinant protein. Examples of mammalian expression systems include the COS-7 lines of monkey kidney fibroblasts, described by Gluzman, Cell, 23:175 (1981), and other cell lines capable of expressing a compatible vector, for example, the C127, 3T3, CHO, HeLa and BHK cell lines. Mammalian expression vectors will comprise an origin of replication, a suitable promoter and enhancer, and also any necessary ribosome binding sites, polyadenylation site, splice donor and acceptor sites, transcriptional termination sequences, and 5' flanking non-transcribed sequences. DNA sequences derived from the SV40 splice, and polyadenylation sites may be used to provide the required nontranscribed genetic elements.

The polypeptide can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the mature protein. High performance liquid chromatography (HPLC) can be employed for final purification steps.

The immunogenic peptides of the present invention may be used to elicit CTLs ex vivo from either healthy individuals or from cancer patients with cancer, such as colorectal carcinoma, lung carcinoma, ovarian carcinoma, breast carcinoma, or prostate carcinoma. Such responses are induced by incubating in tissue culture the individual's CTL precursor lymphocytes together with a source of antigen presenting cells and the appropriate immunogenic peptide. Examples of suitable antigen presenting cells include dendritic cells, macrophages, and activated B cells. Typically, the peptide at concentrations between 10 and 40 µg/ml, would be pre-incubated with the antigen presenting cells for periods ranging from 1 to 18 hrs. $\beta_2$-microglobulin (4 µg/ml) can be added during this time period to enhance binding. The antigen presenting cells may also be held at room temperature during the incubation period (Ljunggren, H.-G. et al., Nature, 346:476-480, (1990)) or pretreated with acid (Zeh, H. J., III et al., Hum. Immunol., 39:79-86, (1994)) to promote the generation of denatured class I MHC molecules which can then bind the peptide. The precursor CTLs (responders) are then added to the antigen presenting cells to which the immunogenic peptide has bound (stimulators) at responder to stimulator ratios of between 5:1 and 50:1, and most typically between 10:1 and 20:1. The co-cultivation of the cells is carried out at 37° C. in RPMI 1640, 10% fetal bovine serum, 2 mM L-glutamine, and IL-2 (5-20 Units/ml). Other cytokines, such as IL-1, IL-7, and IL-12 may also be added to the culture. Fresh IL-2-containing media is added to the cultures every 2-4 days, typically by removing one-half the old media and replenishing it with an equal volume of fresh media. After 7-10 days, and every 7-10 days thereafter, the CTL are re-stimulated with antigen presenting cells to which immunogenic peptide has been bound as described above. Fresh IL-2-containing media is added to the cells throughout their culture as described above. Three to four rounds of stimulation, and sometimes as many five to eight rounds of stimulation, are required to generate a CTL response that can then be measured in vitro. The above described protocol is illustrative only and should not be considered limiting. Many in vitro CTL stimulation protocols have been described and the choice of which one to use is well within the knowledge of the skilled artisan. The peptide-specific CTL can be further expanded to large numbers by treatment with anti-CD3 antibody. For example, see (Riddell, S. R. and Greenberg, P. D., J. Immunol. Methods, 128:189-201, (1990); Walter, E. A. et al., N. Engl. J. Med., 333:1038-1044, (1995)).

Antigen presenting cells that are to be used to stimulate a CTL response are typically incubated with peptide of an optimal length, most commonly a nonapeptide, that allows for direct binding of the peptide to the class I MHC molecule without additional processing. Larger oligopeptides and polypeptides are generally ineffective in binding to class I MHC molecules as they are not efficiently processed into an appropriately sized peptide in the extracellular milieu. There a variety of approaches that are known in the art, however, that allow oligopeptides and polypeptides to be exogenously acquired by a cell, which then allows for their subsequent processing and presentation by a class I MHC molecule. Representative, but non-limiting examples of such approaches include electroporation of the molecules into the cell (Harding, C. H. III, Eur. J. Immunol., 22:1865-1869, (1992)), encapsulation of the molecules in liposomes which are fused to the cells of interest (Reddy, R. et al., J. Immunol. Methods, 141:157-163, (1991)), or osmotic shock in which the molecules are taken up via pinocytosis (Moore, M. W. et al., Cell, 54:777-785, (1988)). Thus, oligopeptides and polypeptides that comprise one or more of the peptides of the invention can be provided to antigen presenting cells in such a fashion that they are delivered to the cytoplasm of the cell, and are subsequently processed to allow presentation of the peptides.

Antigen presenting cells suitable for stimulating an in vitro CTL response that is specific for one or more of the peptides of the invention can also be prepared by introducing polynucleotide vectors encoding the sequences into the cells. These polynucleotides can be designed such that they express only a single peptide of the invention, multiple peptides of the invention, or even a plurality of peptides of the invention. There are a variety of approaches that are known in the art, that allow polynucleotides to be introduced and expressed in a cell, thus providing one or more peptides of the invention to the class I MHC molecule binding pathway. Representative, but non-limiting examples of such approaches include the introduction of plasmid DNA through particle-mediated gene transfer or electroporation (Tuting, T. et al., J. Immunol., 160:1139-1147, (1998)), or the transduction of cells with an adenovirus expressing the polynucleotide of interest (Perez-Diez, A. et al., Cancer Res., 58:5305-5309, (1998)). Thus, oligonucleotides that code for one or more of the peptides of the invention can be provided to antigen presenting cells in such a fashion that the peptides associate with class I MHC molecules and are presented on the surface of the antigen presenting cell, and consequently are available to stimulate a CTL response.

By preparing the stimulator cells used to generate an in vitro CTL response in different ways, it is possible to control the peptide specificity of CTL response. For example, the CTLs generated with a particular peptide will necessarily be specific for that peptide. Likewise, CTLs that are generated with a polypeptide or polynucleotide expressing or coding for particular peptides will be limited to specificities that recognize those peptides. More broadly, stimulator cells, and more specifically dendritic cells, can be incubated in the presence of the whole protein. As a further alternative, stimulator cells, and more specifically dendritic cells, can be transduced or transfected with RNA or DNA comprising the polynucleotide sequence encoding the protein. Under these alternative conditions, peptide epitopes that are naturally cleaved out of the protein, and which are generated in addition to peptide epitopes of SEQ ID NO:1-791 and 1514-1533 can associate with an appropriate class I MHC molecule, which may or may not include HLA-A1, -A2, or -A3. The selection of antigen presenting cells and the type of antigen with which to stimulate the CTL, is left to the ordinary skilled artisan.

In certain embodiments, the methods of the present invention include a method for inducing a CTL response in vitro that is specific for a tumor cell expressing a molecule from A1, A2, or A3 supertypes (A11 is a member of the A3 supertype), whereby the method comprises contacting a CTL precursor lymphocyte with an antigen presenting cell that has bound an immunogen comprising one or more of the peptides disclosed according to the invention.

In specific embodiments, the methods of the present invention include a method for inducing a CTL response in vitro that is specific for a tumor cell expressing a molecule from A1, A2, or A3 supertypes, whereby the method comprises contacting a CTL precursor lymphocyte with an antigen presenting cell that has exogenously acquired an immunogenic oligopeptide or polypeptide that comprises one or more of the peptides disclosed according to the invention.

A yet additional embodiment of the present invention is directed to a process for inducing a CTL response in vitro that is specific for a tumor cell expressing a molecule from A1, A2, or A3 supertypes, comprising contacting a CTL precursor lymphocyte with an antigen presenting cell that is expressing a polynucleotide coding for a polypeptide of the invention and wherein said polynucleotide is operably linked to a promoter.

In specific embodiments, the methods of the present invention include a method for inducing a CTL response in vitro that is specific for a tumor cell expressing HLA-A1, HLA-A2, or HLA-A11, whereby the method comprises contacting a CTL precursor lymphocyte with an antigen presenting cell that has bound an immunogen comprising one or more of the peptides disclosed according to the invention.

In specific embodiments, the methods of the present invention include a method for inducing a CTL response in vitro that is specific for a tumor cell expressing HLA-A1, HLA-A2, or HLA-A11, whereby the method comprises contacting a CTL precursor lymphocyte with an antigen presenting cell that has exogenously acquired an immunogenic oligopeptide or polypeptide that comprises one or more of the peptides disclosed according to the invention.

A yet additional embodiment of the present invention is directed to a process for inducing a CTL response in vitro that is specific for a tumor cell expressing HLA-A1, HLA-A2, or HLA-A11, comprising contacting a CTL precursor lymphocyte with an antigen presenting cell that is expressing a polynucleotide coding for a polypeptide of the invention and wherein said polynucleotide is operably linked to a promoter.

A variety of techniques exist for assaying the activity of CTL. These techniques include the labeling of target cells with radionuclides such as $Na_2^{51}CrO_4$ or $^3H$-thymidine, and measuring the release or retention of the radionuclides from the target cells as an index of cell death. Such assays are well-known in the art and their selection is left to the skilled artisan. Alternatively, CTL are known to release a variety of cytokines when they are stimulated by an appropriate target cell, such as a tumor cell expressing the relevant class I MHC molecule and the corresponding peptide. Non-limiting examples of such cytokines include IFN-γ, TNFα, and GM-CSF. Assays for these cytokines are well known in the art, and their selection is left to the skilled artisan. Methodology for measuring both target cell death and cytokine release as a measure of CTL reactivity are given in (Coligan, J. E. et al, Current Protocols in Immunology, 1999, John Wiley & Sons, Inc., New York).

After expansion of the antigen-specific CTLs, the latter are then adoptively transferred back into the patient, where they will destroy their specific target cell. The utility of such adoptive transfer is demonstrated in North, R. J. et al. (Infect. Immun., 67:2010-2012, (1999)) and Riddell, S. R. et al. (Science, 257:238-241, (1992)). In determining the amount of cells to reinfuse, the skilled physician will be guided by the total number of cells available, the activity of the CTL as measured in vitro, and the condition of the patient. Preferably, however, about $1\times10^6$ to about $1\times10^{12}$, more preferably about $1\times10^8$ to about $1\times10^{11}$, and even more preferably, about $1\times10^9$ to about $1\times10^{10}$ peptide-specific CTL are infused. Methodology for reinfusing the T cells into a patient are well known and exemplified in U.S. Pat. No. 4,844,893 to Honski, et al., and U.S. Pat. No. 4,690,915 to Rosenberg.

The peptide-specific CTL can be purified from the stimulator cells prior to infusion into the patient. For example, monoclonal antibodies directed towards the cell surface protein CD8, present on CTL, can be used in conjunction with a variety of isolation techniques such as antibody panning, flow cytometric sorting, and magnetic bead separation to purify the peptide-specific CTL away from any remaining non-peptide specific lymphocytes or from the stimulator cells. These methods are well known in the art, and are their selection is left to the skilled artisan. It should be appreciated that generation of peptide-specific CTL in this manner, obviates the need for stimulating the CTL in the presence of tumor. Thus, there is no chance of inadvertently reintroducing tumor cells into the patient.

Thus, one embodiment of the present invention relates to a process for treating a subject with cancer characterized by tumor cells expressing complexes of a molecule from A1, A2, or A3 supertypes, for example, HLA-A1, HLA-A2, or HLA-A11, whereby CTLs produced in vitro according to the present invention are administered in an amount sufficient to destroy the tumor cells through direct lysis or to effect the destruction of the tumor cells indirectly through the elaboration of cytokines.

Another embodiment of the present invention is directed to a process for treating a subject with cancer characterized by tumor cells expressing any class I MHC molecule and an epitope of SEQ ID NO: 1-791 and 1514-1533, whereby the CTLs are produced in vitro and are specific for the epitope or original protein and are administered in an amount sufficient to destroy the tumor cells through direct lysis or to effect the destruction of the tumor cells indirectly through the elaboration of cytokines.

In the foregoing embodiments the cancer to be treated may include a colorectal carcinoma, an ovarian carcinoma, a breast carcinoma, a lung carcinoma, and prostate carcinoma, but especially ovarian carcinoma.

The ex vivo generated CTL can be used to identify and isolate the T cell receptor molecules specific for the peptide. The genes encoding the alpha and beta chains of the T cell receptor can be cloned into an expression vector system and transferred and expressed in naive T cells from peripheral blood, T cells from lymph nodes, or T lymphocyte progenitor cells from bone marrow. These T cells, which would then be expressing a peptide-specific T cell receptor, would then have anti-tumor reactivity and could be used in adoptive therapy of cancer, and more specifically cancer, colorectal carcinoma, ovarian carcinoma, breast carcinoma, lung carcinoma, and prostate carcinoma.

In addition to their use for therapeutic or prophylactic purposes, the immunogenic peptides of the present invention are useful as screening and diagnostic agents. Thus, the immunogenic peptides of the present invention, together with modern techniques of gene screening, make it possible to screen patients for the presence of genes encoding such peptides on cells obtained by biopsy of tumors detected in such patients. The results of such screening may help determine the efficacy of proceeding with the regimen of treatment disclosed herein using the immunogens of the present invention.

Alternatively, the immunogenic peptides disclosed herein, as well as functionally similar homologs thereof, may be used to screen a sample for the presence of CTLs that specifically recognize the corresponding epitopes. The lymphocytes to be screened in this assay will normally be obtained from the peripheral blood, but lymphocytes can be obtained from other sources, including lymph nodes, spleen, tumors, and pleural fluid. The peptides of the present invention may then be used as a diagnostic tool to evaluate the efficacy of the immunotherapeutic treatments disclosed herein. Thus, the in vitro generation of CTL as described above would be used to determine if patients are likely to respond to the peptide in vivo. Similarly, the in vitro generation of CTL could be done with samples of lymphocytes obtained from the patient before and after treatment with the peptides. Successful generation of CTL in vivo should then be recognized by a correspondingly easier ability to generate peptide-specific CTL in vitro from lymphocytes obtained following treatment in comparison to those obtained before treatment.

The oligopeptides of the invention, such as SEQ ID NO: 1-791 and 1514-1533, can also be used to prepare class I MHC tetramers which can be used in conjunction with flow cytometry to quantitate the frequency of peptide-specific CTL that are present in a sample of lymphocytes from an individual. Specifically, for example, class I MHC molecules comprising peptides of SEQ ID NO: 1-791 and 1514-1533, would be combined to form tetramers as exemplified in U.S. Pat. No. 5,635,363. Said tetramers would find use in monitoring the frequency of CTLs in the peripheral blood, lymph nodes, or tumor mass of an individual undergoing immunotherapy with the peptides, proteins, or polynucleotides of the invention, and it would be expected that successful immunization would lead to an increase in the frequency of the peptide-specific CTL.

As stated above, a vaccine in accordance with the present invention may include one or more of the hereinabove described polypeptides or active fragments thereof, or a composition, or pool, of immunogenic peptides disclosed herein. When employing more than one polypeptide or active fragment, two or more polypeptides and/or active fragments may be used as a physical mixture or as a fusion of two or more polypeptides or active fragments. The fusion fragment or fusion polypeptide may be produced, for example, by recombinant techniques or by the use of appropriate linkers for fusing previously prepared polypeptides or active fragments.

The immunogenic molecules of the invention, including vaccine compositions, may be utilized according to the present invention for purposes of preventing, suppressing or treating diseases causing the expression of the immunogenic peptides disclosed herein, such as where the antigen is being expressed by tumor cells. As used in accordance with the present invention, the term "prevention" relates to a process of prophylaxis in which an animal, especially a mammal, and most especially a human, is exposed to an immunogen of the present invention prior to the induction or onset of the disease process. This could be done where an individual has a genetic pedigree indicating a predisposition toward occurrence of the disease condition to be prevented. For example, this might be true of an individual whose ancestors show a predisposition toward certain types of cancer. Alternatively, the immunogen could be administered to the general population as is frequently done for infectious diseases. Alternatively, the term "suppression" is often used to describe a condition wherein the disease process has already begun but obvious symptoms of said condition have yet to be realized. Thus, the cells of an individual may have become cancerous but no outside signs of the disease have yet been clinically recognized. In either case, the term prophylaxis can be applied to encompass both prevention and suppression. Conversely, the term "treatment" is often utilized to mean the clinical application of agents to combat an already existing condition whose clinical presentation has already been realized in a patient. This would occur where an individual has already been diagnosed as having a tumor.

It is understood that the suitable dosage of an immunogen of the present invention will depend upon the age, sex, health, and weight of the recipient, the kind of concurrent treatment, if any, the frequency of treatment, and the nature of the effect desired. However, the most preferred dosage can be tailored to the individual subject, as determined by the researcher or clinician. The total dose required for any given treatment will commonly be determined with respect to a standard reference dose as set by a manufacturer, such as is commonly done with vaccines, such dose being administered either in a single treatment or in a series of doses, the success of which will depend on the production of a desired immunological result (i.e., successful production of a CTL-mediated response to the antigen, which response gives rise to the prevention and/or treatment desired). Thus, the overall administration schedule must be considered in determining the success of a course of treatment and not whether a single dose, given in isolation, would or would not produce the desired immunologically therapeutic result or effect.

The therapeutically effective amount of a composition containing one or more of the immunogens of this invention, is an amount sufficient to induce an effective CTL response to the antigen and to cure or arrest disease progression. Thus, this dose will depend, among other things, on the identity of the immunogens used, the nature of the disease condition, the severity of the disease condition, the extent of any need to prevent such a condition where it has not already been detected, the manner of administration dictated by the situation requiring such administration, the weight and state of health of the individual receiving such administration, and the sound judgment of the clinician or researcher. Thus, for purposes of prophylactic or therapeutic administration, effective amounts would generally lie within the range of from 1.0 µg to about 5,000 µg of peptide for a 70 kg patient, followed by boosting dosages of from about 1.0 µg to about 1,000 µg of peptide pursuant to a boosting regimen over days, weeks or even months, depending on the recipient's response and as necessitated by subsequent monitoring of CTL-mediated activity within the bloodstream. Of course, such dosages are to be considered only a general guide and, in a given situation, may greatly exceed such suggested dosage regimens where the clinician believes that the recipient's condition warrants more a aggressive administration schedule. Needless to say, the efficacy of administering additional doses, and of increasing or decreasing the interval, may be re-evaluated on a continuing basis, in view of the recipient's immunocompetence (for example, the level of CTL activity with respect to tumor-associated or tumor-specific antigens).

For such purposes, the immunogenic compositions according to the present invention may be used against a disease condition such as cancer by administration to an individual by a variety of routes. The composition may be administered parenterally or orally, and, if parenterally, either systemically or topically. Parenteral routes include subcutaneous, intravenous, intradermal, intramuscular, intraperitoneal, intranasal, transdermal, or buccal routes. One or more such routes may be employed. Parenteral administration can be, for example, by bolus injection or by gradual perfusion over time.

Generally, vaccines are prepared as injectables, in the form of aqueous solutions or suspensions. Vaccines in an oil base are also well known such as for inhaling. Solid forms which are dissolved or suspended prior to use may also be formulated. Pharmaceutical carriers, diluents and excipients are generally added that are compatible with the active ingredients and acceptable for pharmaceutical use. Examples of such carriers include, but are not limited to, water, saline solutions, dextrose, or glycerol. Combinations of carriers may also be used. These compositions may be sterilized by conventional, well known sterilization techniques including sterile filtration. The resulting solutions may be packaged for use as is, or the aqueous solutions may be lyophilized, the lyophilized preparation being combined with sterile water before administration. Vaccine compositions may further incorporate additional substances to stabilize pH, or to function as adjuvants, wetting agents, or emulsifying agents, which can serve to improve the effectiveness of the vaccine.

The concentration of the CTL stimulatory peptides of the invention in pharmaceutical formulations are subject to wide variation, including anywhere from less than 0.01% by weight to as much as 50% or more. Factors such as volume and viscosity of the resulting composition must also be considered. The solvents, or diluents, used for such compositions include water, possibly PBS (phosphate buffered saline), or saline itself, or other possible carriers or excipients.

The immunogens of the present invention may also be contained in artificially created structures such as liposomes, ISCOMS, slow-releasing particles, and other vehicles which increase the immunogenicity and/or half-life of the peptides or polypeptides in serum. Liposomes include emulsions, foams, micelies, insoluble monolayers, liquid crystals, phospholipid dispersions, lamellar layers and the like. Liposomes for use in the invention are formed from standard vesicle-forming lipids which generally include neutral and negatively charged phospholipids and a sterol, such as cholesterol. The selection of lipids is generally determined by considerations such as liposome size and stability in the blood. A variety of methods are available for preparing liposomes as reviewed, for example, by (Coligan, J. E. et al, Current Protocols in Protein Science, 1999, John Wiley & Sons, Inc., New York) and see also U.S. Pat. Nos. 4,235,871, 4,501,728, 4,837,028, and 5,019,369.

Liposomes containing the peptides or polypeptides of the invention can be directed to the site of lymphoid cells where the liposomes then deliver the selected immunogens directly to antigen presenting cells. Targeting can be achieved by incorporating additional molecules such as proteins or polysaccharides into the outer membranes of said structures, thus resulting in the delivery of the structures to particular areas of the body, or to particular cells within a given organ or tissue. Such targeting molecules may a molecule that binds to receptor on antigen presenting cells. For example an antibody that binds to CD80 could be used to direct liposomes to dendritic cells.

The immunogens of the present invention may also be administered as solid compositions. Conventional nontoxic solid carriers including pharmaceutical grades of mannitol, lactose, starch, magnesium, cellulose, glucose, sucrose, sodium saccharin, and the like. Such solid compositions will often be administered orally, whereby a pharmaceutically acceptable nontoxic composition is formed by incorporating the peptides and polypeptides of the invention with any of the carriers listed above. Generally, such compositions will contain 10-95% active ingredient, and more preferably 25-75% active ingredient.

Aerosol administration is also an alternative, requiring only that the immunogens be properly dispersed within the aerosol propellant. Typical percentages of the peptides or polypeptides of the invention are 0.01%-20% by weight, preferably 1%-10%. The use of a surfactant to properly disperse the immunogen may be required. Representative surfactants include the esters or partial esters of fatty acids containing from 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute 0.1-20% by weight of the composition, preferably 0.25-5%. Typical propellants for such administration may include esters and similar chemicals but are by no means limited to these. A carrier, such as lecithin for intranasal delivery, may also be included.

The peptides and polypeptides of the invention may also be delivered with an adjuvant. Adjuvants include, but are not limited to complete or incomplete Freund's adjuvant, Montanide ISA-51, Lymphocyte Activation Gene-3 (LAG-)3, aluminum phosphate, aluminum hydroxide, alum, and saponin. Adjuvant effects can also be obtained by injecting a variety of cytokines along with the immunogens of the invention. These cytokines include, but are not limited to IL-1, IL-2, IL-7, IL-12, and GM-CSF.

The peptides and polypeptides of the invention can also be added to professional antigen presenting cells such as dendritic cells that have been prepared ex vivo. For example, the dendritic cells could be prepared from CD34 positive stem cells from the bone marrow, or they could be prepared from CD14 positive monocytes obtained from the peripheral blood. The dendritic cells are generated ex vivo using cytokines such as GM-CSF, IL-3, IL-4, TNF, and SCF. The cultured DC are then pulsed with peptides at various concentrations using standard methods that are well known in the art. The peptide-pulsed dendritic cells can then be administered either intraveneously, subcutaneously, or intradermally, and the immunization may also include cytokines such as IL-2 or IL-12.

The present invention is also directed to a vaccine in which an immunogen of the present invention is delivered or administered in the form of a polynucleotide encoding the a polypeptide or active fragment as disclosed herein, whereby the peptide or polypeptide or active fragment is produced in vivo. The polynucleotide may be included in a suitable expression vector and combined with a pharmaceutically acceptable carrier. For example, the peptides or polypeptides could be expressed in plasmid DNA and nonreplicative viral vectors such as vaccinia, fowlpox, Venezuelan equine encephalitis virus, adenovirus, or other RNA or DNA viruses. These examples are meant to be illustrative only and should not be viewed as self-limiting A wide variety of other vectors are available and are apparent to those skilled in the art from the description given herein. In this approach, a portion of the nucleotide sequence of the viral vector is engineered to express the peptides or polypeptides of the invention. Vaccinia vectors and methods useful in immunization protocols are described in U.S. Pat. No. 4,722,848, the disclosure of which is incorporated herein by reference in its entirety.

Regardless of the nature of the composition given, additional therapeutic agents may also accompany the immunogens of the present invention. Thus, for purposes of treating tumors, compositions containing the immunogens disclosed herein may, in addition, contain other antitumor pharmaceuticals. The use of such compositions with multiple active ingredients is left to the discretion of the clinician.

In addition, the immunogens of the present invention can be used to stimulate the production of antibodies for use in passive immunotherapy, for use as diagnostic reagents, and for use as reagents in other processes such as affinity chromatography.

The present invention also relates to antibodies that react with immunogens, such as a polypeptide comprising one or more of the epitopic peptides of SEQ ID NO: 1-791 and 1514-1533 as disclosed herein. Active fragments of such antibodies are also specifically contemplated. Such antibodies, and active fragments of such antibodies, for example, and Fab structure, may react with, including where it is highly selective or specific for, an immunogenic structure comprising 2, 3, 4 or more of the epitopic peptides of the invention.

With the advent of methods of molecular biology and recombinant technology, it is now possible to produce antibody molecules by recombinant means and thereby generate gene sequences that code for specific amino acid sequences found in the polypeptide structure of the antibodies. Such antibodies can be produced by either cloning the gene sequences encoding the polypeptide chains of said antibodies or by direct synthesis of said polypeptide chains, with in vitro assembly of the synthesized chains to form active tetrameric ($H_2L_2$) structures with affinity for specific epitopes and antigenic determinants. This has permitted the ready production of antibodies having sequences characteristic of neutralizing antibodies from different species and sources.

Regardless of the source of the antibodies, or how they are recombinantly constructed, or how they are synthesized, in vitro or in vivo, using transgenic animals, such as cows, goats and sheep, using large cell cultures of laboratory or commercial size, in bioreactors or by direct chemical synthesis employing no living organisms at any stage of the process, all antibodies have a similar overall 3 dimensional structure. This structure is often given as H2L2 and refers to the fact that antibodies commonly comprise 2 light (L) amino acid chains and 2 heavy (H) amino acid chains. Both chains have regions capable of interacting with a structurally complementary antigenic target. The regions interacting with the target are referred to as "variable" or "V" regions and are characterized by differences in amino acid sequence from antibodies of different antigenic specificity.

The variable regions of either H or L chains contains the amino acid sequences capable of specifically binding to antigenic targets. Within these sequences are smaller sequences dubbed "hypervariable" because of their extreme variability between antibodies of differing specificity. Such hypervariable regions are also referred to as "complementarity determining regions" or "CDR" regions. These CDR regions account for the basic specificity of the antibody for a particular antigenic determinant structure.

The CDRs represent non-contiguous stretches of amino acids within the variable regions but, regardless of species, the positional locations of these critical amino acid sequences within the variable heavy and light chain regions have been found to have similar locations within the amino acid sequences of the variable chains. The variable heavy and light chains of all antibodies each have 3 CDR regions, each non-contiguous with the others (termed L1, L2, L3, H1, H2, H3) for the respective light (L) and heavy (H) chains. The accepted CDR regions have been described in the text and figures of Kabat et al. (J. Biol. Chem. 252:6609-6616 (1977)).

In all mammalian species, antibody polypeptides contain constant (i.e., highly conserved) and variable regions, and, within the latter, there are the CDRs and the so-called "framework regions" made up of amino acid sequences within the variable region of the heavy or light chain but outside the CDRs.

The antibodies disclosed according to the invention may also be wholly synthetic, wherein the polypeptide chains of the antibodies are synthesized and, possibly, optimized for binding to the polypeptides disclosed herein as being receptors. Such antibodies may be chimeric or humanized antibodies and may be fully tetrameric in structure, or may be dimeric and comprise only a single heavy and a single light chain. Such antibodies may also include fragments, such as Fab and F(ab$_2$)' fragments, capable of reacting with and binding to any of the polypeptides disclosed herein as being receptors.

A further embodiment of the present invention relates to a method for inducing a CTL response in a subject comprising administering to subjects that express HLA-A1 antigens an effective (i.e., CTL-stimulating amount) of an immunogen of the invention that does not comprise the entire protein expressing the epitopic peptides disclosed herein (i.e., one that comprises less than the entire protein where the protein is a naturally occurring polypeptide) in an amount sufficient to induce a CTL response to tumor cells expressing at least HLA-A1 or HLA-A2, as the case may be, thereby eliciting a cellular response against said tumor cells.

A still further embodiment of the present invention relates to a method for inducing a CTL response in a subject, wherein the immunogen is in the form of a polynucleotide. In one non-limiting example, the method comprises administering to subjects that express HLA-A1 at least one CTL epitope, wherein said epitope or epitopes are selected from a group comprising the peptides disclosed according to the invention, and are coded within a polynucleotide sequence that does not comprise the entire protein coding region, in an amount sufficient to induce a CTL response to tumor cells expressing HLA-A1 or HLA-A2.

While the below examples are provided to illustrate the invention, it is to be understood that these methods and examples in no way limit the invention to the embodiments described herein and that other embodiments and uses will no doubt suggest themselves to those skilled in the art. All publications, patents, and patent applications cited herein are hereby incorporated by reference, as are the references cited therein. It is also to be understood that throughout this disclosure where the singular is used, the plural may be inferred and vice versa and use of either is not to be considered limiting.

EXAMPLE 1

Cell Lines

For HLA-A1 and HLA-A11 studies, ARGOV57, a HLA-A1/11 positive ovarian cell line, was established by culturing tumor cells from an ascitic fluid from an ovarian patient.

For HLA-A2 studies, OVCAR3, a HLA-A2 positive ovarian carcinoma cell line, was established by culturing tumor cells from an ascitic fluid from an ovarian patient.

SKOV3-A2, a HLA-A2 stably expressing ovarian carcinoma cell line, was established by culturing tumor cells from an ascitic fluid from an ovarian patient and transduced with HLA-A2 gene.

EXAMPLE 2

Immunoaffinity Purification

ARGOV57 cells were grown in 10-chamber Nunc cell factories (Fisher, Pittsburgh, Pa.). The cells were harvested by treatment with 0.45% trypsin and 0.32 mM EDTA, washed two times in phosphate-buffered saline solution (pH 7.4), and stored as cell pellets at −80° C. Aliquots of 6-8×10$^{10}$ cells were solubilized at 5-10×10$^6$ cells/ml in 20 mM Tris, pH 8.0, 150 mM NaCl, 1% CHAPS, 18.5 µg/ml iodoacetamide, 5 µg/ml aprotonin, 10 µg/ml leupeptin, 10 µg/ml pepstatin A, 5 mM EDTA, 0.2% sodium azide, and 17.4 µg/ml phenylmethylsulfonyl fluoride for 1 h. This and all subsequent steps were performed with ice-cold solutions and at 4° C. The lysates were then centrifuged at 100,000×g, the pellets discarded, and the supernatants passed through a 0.22 µm filter. The supernatants were then passed over a series of columns with the first containing Sepharose, and the second containing the HLA-A1-specific monoclonal antibody, GAP-A1, bound to a protein A-Sepharose matrix. The second column was then sequentially washed with 20 column volumes of 20 mM Tris, pH 8.0, 150 mM NaCl, 20 column volumes of 20 mM Tris, pH 8.0, 1.0 M NaCl, and 20 column volumes of 20 mM Tris, pH 8.0. The peptides were eluted from the column with 5 column volumes of 10% acetic acid. The isolated HLA-A1 molecules were then boiled for 5 min to further dissociate any bound peptide from the heavy chains. The peptides were then separated from the co-purifying class I heavy chain and $\beta_2$-microglobulin by centrifugation on a Ultrafree-CL membrane with a nominal molecular weight cut-off of 5,000 Daltons (Millipore, Bedford, Mass.).

For a separate study, OVCAR3 or SKOV3 cells were successfully prepared using the same procedure as just described except that HLA-A2 molecules were prepared using HLA-A2 specific antibodies.

EXAMPLE 3

Peptide Fractionation

The peptide extracts were fractionated by RP-HPLC (Reversed Phase-High Performance Liquid Chromatography) using an Applied Biosystems (ABI) model 140B system. The extracts were concentrated by vacuum centrifugation from about 20 ml down to 250 µl and injected into either a Brownlee (Norwalk, Conn.) $C_{18}$ Aquapore column (2.1 mm×3 cm; 300 Å; 7 µm) or a Higgins (Mountain View, Calif.) C18 Haisil column (2.1 mm×4 cm; 300 Å; 5 µm). The peptides were eluted by first using a gradient of acetonitrile/0.085% TFA (trifluoroacetic acid) in 0.1% TFA/water, with the concentration of acetonitrile increasing from 0-9% (0-5 minutes), 9-36% (5-55 minutes), and 36-60% (55-62 minutes). A second dimension fractionation of combined fractions 17 and 18 from the first dimension (TFA) fraction was accomplished using the same gradient but with the substitution of HFBA (heptafluorobutyric acid) for TFA. The flow rate was 200 µl/min, and fractions were collected at 1 min (Brownlee column) or 40 second (Higgins column) intervals. A third dimension of RP-HPLC was achieved using an Eldex (Napa, Calif.) MicroPro Pump, a homemade $C_{18}$ microcapillary column, and an ABI model 785A UV absorbance detector. The column was prepared by packing a 27 cm bed of 10 µm $C_{18}$ particles in a section of 285 µm o.d./75 µm i.d. fused silica (Polymicro Technologies, Phoenix, Ariz.). Peptides in combined fractions 26 and 27 of the second dimension fraction were loaded onto this column and eluted with a gradient of acetonitrile/0.67% triethylamine acetate/water in 0.1% triethylamine acetate/water, with the concentration of acetonitrile increasing from 0-60% in 40 minutes. The flow rate was about 300 nl/min, and fractions were collected into 25 µl of water every 30 s. In all RP-HPLC experiments, peptides were detected by monitoring UV absorbance at 214 nm.

EXAMPLE 4

Mass Spectrometric Analysis

The second dimension HPLC fraction was analyzed using an affluent splitter on the microcapillary HPLC column. In this experiment, the column (360 µm o.d.×100 µm i.d. with a 25 cm $C_{18}$ bed) was butt connected with a zero dead volume tee (Valco, Houston, Tex.) to two pieces of fused silica of different lengths (25 µm and 40 µm i.d.). Peptides were eluted with a 34 min gradient of 0-60% acetonitrile. The 25 m capillary deposited one-fifth of the HPLC effluent into the wells of a microtiter plate for use in CTL epitope reconstitution assays, whereas the remaining four-fifths of the effluent was directed into the mass spectrometer. Ions were formed by electrospray ionization, and mass spectra were recorded by scanning between mass to charge ratios (m/z) 300 and 1400 every 1.5 seconds. Peptide sequences were determined by CAD (collision-activated dissociation) tandem mass spectrometry as described in the literature (Hunt, D. F. et al., Proc. Natl. Acad. Sci. U.S.A, 83:6233-6237, (1986)).

EXAMPLE 5

Homology Searches of Identified Peptide Sequences

Proteins containing peptides corresponding to the masses identified by MS were analyzed with the search algorithm, SEQUEST. Searches were also carried out on the GenBank non-redundant sequence database (http:/ncbi,nlm.nih.gov/Entrez/) as well as on our own unique database of 2943 specific sequences compiled from GenBank and EST database entries. Upon experimental confirmation of the peptide Sequence, a tBLASTn search of the GenBank non redundant databaxe was performed to identify any genes containing the DNA sequence encoding the peptice.

EXAMPLE 6

Peptide Synthesis

Peptides were synthesized using a Gilson (Madison, Wis.) AMS 422 multiple peptide synthesizer. Quantities of 10 µMol were synthesized using conventional FMOC amino acids, resins, and chemical techniques. Peptides were purified by RP-HPLC using a 4.6 mm×100 mm POROS (Perspective Biosystems, Cambridge, Mass.) column and a 10 min, 0-60% acetonitrile in 0.1% TFA gradient.

EXAMPLE 7

Generation of Monocyte-Derived DC and Peptide Loading

PBMC were purified from HLA-A2$^+$ normal donor blood using lymphocyte separation media (Cappel ICN Biomedical, Aurora, Ohio). PBMC ($5.3×10^6$) were added to individual wells of a 24-well cluster plate (Costar, Corning, N.Y.) in 1.0 ml of serum-free AIM-V medium (Life Technologies) and allowed to adhere for 60 min at 37° C. Non-adherent cells were removed and saved as a source of effector T cells. Adherent PBMC (~$8.3×10^5$/well) were then pulsed with 50 mg/ml synthetic peptides in serum-free AIM-V medium containing 1.5 mg/ml $\beta_2$-microg lobulin (Calbiochem-Novabiochem, San Diego, Calif.) and incubated for 2 h at 37° C. Unbound peptides were aspirated and the wells washed with media.

Monocyte-derived DC were generated as follows. PBMC ($5.3×10^7$) were allowed to adhere in T-75 flasks (Corning) in 10 ml of serum-free AIM-V medium for 60 min at 37° C. Non-adherent cells were collected as a source of effector T cells and pooled with the previous collection above. Adherent monocytes in flasks were then exposed to recombinant human granulocyte macrophage colony stimulating factor (GM-CSF, 25 ng/ml; Peprotech) and recombinant human IL-4 (100 ng/ml; Peprotech) in 10 ml of AIM-V medium containing 10% heat-inactivated FBS. DC obtained by this method [immature DC (iDC)] are characterized by expression of low levels of CD83, CD80, CD86, and HLA class I and class II molecules (data not shown).

Mature DC (mDC) were obtained by exposing day 5 DC cultures to recombinant soluble CD40 ligand (sCD40L; Peprotech) at 1.5 mg/ml for 24 h in the presence of 25 ng/ml GM-CSF and are characterized by expression of high levels of CD80, CD86, and HLA class I and class II molecules. mDC were harvested, washed, pulsed with 5 mg/ml peptide in serum-free AIM-V medium and irradiated (5000 rad) prior to use as stimulators.

EXAMPLE 8

Generation of Peptide-Specific CTL

The protocol used here is a modification of the method described by Plebanski et al. (Eur. J. Immunol. 25:1783, (1995)). CTL to peptide were generated by 3±4 cycles of stimulation with peptide-loaded APC. For the first round of stimulation (day 0), T cells or non-adherent PBMC from above ($2.3 \times 10^6$/ml or $4.3 \times 10^6$ per well) were added in bulk (CD4$^+$, CD8$^+$, NK, etc.) to adherent PBMC-loaded peptides in serum-free medium (50 mg/ml), $\beta_2$-microglobulin (1.5 mg/ml) (Calbiochem-Novabiochem), recombinant human IL-7 (5 ng/ml) (Peprotech) and keyhole limpet hemocyanin (5 mg/ml) (Sigma, St Louis, Mo.). Cultures were re-stimulated with iDC every 7 days, pulsed with varying amounts of peptide (second round 25 mg/ml, third round 10 mg/ml) and irradiated (5000 rad) on day 8. At each re-stimulation, the T cells were transferred to new plates by first aspirating 70% of spent media in wells and then transferring the pooled contents to a new plate. Fresh IL-7 was added at each re-stimulation. The responder:stimulator (T cell:DC) ratio was set at 20 for each stimulation. Recombinant human IL-2 (10 U/ml) was added on day 5 after each re-stimulation.

Prior to $^{51}$Cr-release assay, the T cells were harvested and CD8$^+$ T cells were purified by positive selection using CD8$^+$ microbeads immunomagnetic cell separation with MACS kit (Miltenyi Biotec, Auburn, Calif.). If a fourth round of stimulation was necessary following CTL analysis, the CTL were pulsed as before, except with 5±10 mg/ml of peptide.

EXAMPLE 9

Generation of Allospecific CTL

HLA-A2-allospecific CTL were obtained in a mixed lymphocyte reaction by repeated stimulation of HLA-A3$^+$ PBMC (responders) with irradiated HLA-A2$^+$ stimulator PBMC at a ratio of 10:1 in the presence of 10 U/ml IL-2. Stimulation was repeated weekly with PBMC from different HLA-A2$^+$ donors so as to minimize alloresponse to non-HLA-A2 antigens. T cells were assessed for lysis on several HLA-A2$^+$ targets including tumor cells, EBV-B cells and HLA-A3$^+$ targets every week after the third round of stimulation.

EXAMPLE 10

CTL Expansion

Expansion of large numbers of peptide-specific or HLA-A2-allospecific CTL was achieved by culturing $5.3 \times 10^4 \pm 1.3 \times 10^5$ T cells around day 6 or 7 post peptide- or allostimulation in the presence of $2.5-3.0 \times 10^7$ irradiated (5000 rad) allogeneic normal donor PBMC coated with anti-CD3 antibody at 10 ng/ml (BD PharMingen, San Diego, Calif.) and 25 U/ml of recombinant human IL-2 (Peprotech) in a final volume of 30 ml RPMI medium. Media changes with IL-2 addition (50 U/ml) were effected on days 5 and 8. Cells were harvested for cytotoxicity assays on days 10±12 and re-stimulated or frozen for later use.

EXAMPLE 11

$^{51}$Cr-Release Cytotoxicity Assay

The standard 4-h Cr-release assay was performed in 96-well V-bottomed microplates. Target cells in suspension (T2, C1R.A2, B-LCL and K562) were labeled with 100 mCi Na$_2$$^{51}$CrO4 (NEN Life Science, Boston, Mass.) per $1.3 \times 10^6$ cells either overnight (~6±18 h) in 5 ml RPMI 1640 media containing 2±5% FBS or for 60±90 min at 37° C. directly with the cell pellet in the case of adherent cells (tumor cell lines and control lines). Labeling was terminated by washing the targets with cold media containing 5% FBS for a total of three washes. Target cells were resuspended at a concentration of $2-3 \times 10^4$/ml. About $2-3 \times 10^3$ targets in 100 ml were delivered to each well containing CTL (effectors) seeded at different E:T ratios. Spontaneous release wells contained targets in media alone, while maximal release wells contained targets in 2% NP-40 detergent (Igepal CA-630; Sigma). HLA restriction of CTL-mediated killing was achieved by preincubation of targets with HLA-specific antibodies prior to incubation with CTL.

The plate was gently spun for 1±2 min and incubated at 37° C. for 4 h. For harvesting assay plates, 100 ml of supernatants from the wells was transferred to counting tubes (USA Scientific) and g counts were determined in a g counter (ICN Micromedic Systems, Huntsville, Ala.). Cytolytic activity of T cells was expressed in percent specific lysis as follows: specific lysis={[experimental release (c.p.m.)±spontaneous release (c.p.m.)]/[maximal release (c.p.m.)±spontaneous release (c.p.m.)]}.

EXAMPLE 12

Competitive Inhibition Assay

Peptide-stimulated CTL were reacted with $^{51}$Cr-labeled Ov2 tumor cells (E:T ratio of 40) in the presence of excess of cold targets in a 4-h Cr-release assay. Cold targets were either empty T2 cells, T2 cells pulsed with 1 mg/ml relevant peptide (used to stimulate CTL) or irrelevant (control) peptides (HER-2/neu 369±377 or MART 127±35), or IFN-γ pretreated tumor cells (SKOV3.A2 and OVCAR 3) with the cold target in 5-fold excess of the hot target. Results indicate that (i) CTL show specific interaction with the peptide to which they are sensitized to, and (ii) CTL compete for similar epitopes presented on Ov2 as were found in SKOV3.A2 and OVCAR3 cell lines by MS.

TABLE 2

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 1 | AEAEFYRQV | BCL-6 corepressor long | Q6W2J9 |
| 2 | IYNGDMEKI | isoform_E1B_19K/Bcl-2-interacting protein Nip3 | Q12983 |
| 3 | KEFDGKSLV | Similar to Heat shock protein HSP 90-beta (HSP 84) (HSP 90) | P08238 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 4 | HIPAGTLVQV | Cytochrome P450 11B2, mitochondrial precursor | P19099 |
| 5 | SLAEGLRTV | 2'-5'oligoadenylate synthetase 3 | Q2HJ14 |
| 6 | YLGDGPKLV | 26S protease regulatory subunit 4 (P26s4) | P62191 |
| 7 | YLASLIRSV | 26S proteasome non-ATPase regulatory subunit 7 | P51665 |
| 8 | FVDDYTVRV | 26S proteasome non-ATPase regulatory subunit 14 | O00487 |
| 9 | KLLEPVLLL | 40S ribosomal protein S16 | P62249 |
| 10 | KLIEVDDERKL | 40S ribosomal protein S6 (Phosphoprotein NP33) | P62753 |
| 11 | RLFEGNALL | 40S ribosomal protein S9 | P46781 |
| 12 | TLYEAVREV | 60S ribosomal protein L10a (CSA-19) | P62906 |
| 13 | NMVAKVDEV | 60S ribosomal protein L10a (CSA-19) | P62906 |
| 14 | SLIKQIPRI | 60S ribosomal protein L10a (CSA-19) | P62906 |
| 15 | FLSEEGGHVAV | 6-phosphofructo-2-kinase/fructose-2,6-biphosphatase 4 (6PF-2-K/Fru-2,6-P2ASE testis-type isozyme) | Q16877 |
| 16 | IETINFHEV | Cleavage and polyadenylation specificity factor, 73 kDa subunit (CPSF 73 kDa subunit) | Q9UKF6 |
| 17 | YLNDLIHSV | A kinase anchor protein 10, mitochondrial precursor | O43572 |
| 18 | RVAPEEHPVL | Actin, cytoplasmic 1 (Beta-actin) | P60709 |
| 19 | DVLKIPVQLV | Activated T-cell marker CD109 | Q6YHK3 |
| 20 | LSDFLKANV | Activin receptor type 2A precursor (EC 2.7.11.30) | P27037 |
| 21 | DLCFEKVNV | ADAM19 protein | Q8TBU7 |
| 22 | KLHDINAQL | AP-1 complex subunit beta-1 (Adapter-related protein complex 1 beta-1 subunit) (Beta-adaptin 1) | Q10567 |
| 23 | GNGAPDVFQT | Adaptor-related protein NF01019537 | Q9BYI8 |
| 24 | IDAIRIPVL | Lung alpha/beta hydrolase protein 1 | Q96SE0 |
| 25 | FIASKGVKLV | Alpha-actinin-3 | Q08043 |
| 26 | HRPDLIDY | Alpha-actinin-3 | Q08043 |
| 27 | SPQGLELALPS | Ankyrin-2 (Brain ankyrin) (Ankyrin-B) | Q01484 |
| 28 | KIVKRPSLQFL | Ankyrin repeat and SOCS box protein 17 | Q8WXJ9 |
| 29 | TLVTVSAAKT | Anti-colorectal carcinoma heavy chain | Q65ZQ1 |
| 30 | KVLDGSPIEV | APOBEC1 complementation factor (APOBEC1-stimulating protein) | Q9NQ94 |
| 31 | FLAEHPNVTL | Probable DNA dC->dU-editing enzyme APOBEC-3D (EC 3.5.4.-) | Q96AK3 |
| 32 | NLVQDSLDL | Apolipoprotein-L4 precursor (Apolipoprotein L-IV) | Q9BPW4 |
| 33 | ISENEKLQK | Apoptosis stimulating of p53 protein 1 | Q96KQ4 |
| 34 | VLAARNPAKV | Nucleoporin 188 kDa (arachin) | Q5SRE5 |
| 35 | RYFDGNLEKL | Protein ariadne-1 homolog (ARI-1) (Ubiquitin-conjugating enzyme E2-binding protein 1) | Q9Y4X5 |
| 36 | TLADVLYHV | Set1/Ash2 histone methyltransferase complex subunit ASH2 (ASH2-like protein) | Q9UBL3 |
| 37 | LPSPKPMKMKN | ATP synthase F0 subunit 8 Splice isoform 2 of Q9H7F0 | Q85KZ3 |
| 38 | ISSMLVLFF | ATPase_family_homolog_up-regulated_in_senescence_cells_ Probable phospholipid-transporting | Q9H7F0 |
| 39 | SPDEGALVRA | ATPase 1A (EC 3.6.3.1) (Chromaffin granule ATPase II) | Q9Y2Q0 |
| 40 | ILLITLIPY | ATP-binding cassette A10 | Q8WWZ4 |
| 41 | NLEQQETEP | ATP-binding cassette sub-family A member 2 (ATP-binding cassette transporter 2) (ATP-binding cassette 2) | Q9BZC7 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 42 | RKVLYVMEL | Autoantigen RCD8 | Q6P2E9 |
| 43 | EAIPARKLK | xonemal dynein heavy chain 8 | Q96JB1 |
| 44 | SLRLENITV | Butyrophilin-like protein 8 precursor | Q6UX41 |
| 45 | SYVLKKAQV | Ubiquitin carboxyl-terminal hydrolase 20 (EC 3.1.2.15) | Q9Y2K6 |
| 46 | KLIHPKLEY | Bardet-Biedl syndrome 7 protein (BBS2-like protein 1) | Q8IWZ6 |
| 47 | EFDQLDQEN | Large proline-rich protein BAT2 (HLA-B-associated transcript 2) | P48634 |
| 48 | TVLLRLGDEL | Bcl-2 related ovarian killer | |
| 49 | LFEILIEQI | Lipopolysaccharide-responsive and beige-like anchor protein (CDC4-like protein) | P50851 |
| 50 | KLELDETGQE | Splice isoform 3 of P35612 | P35612-3 |
| 51 | LAIGAFTLLL | UDP-GlcNAc: betaGal beta-1,3-N-acetylglucosaminyltransferase 3 (EC 2.4.1.-) | Q9Y2A9 |
| 52 | QILLDETLK | Cell growth inhibiting protein 39 | Q2TTR2 |
| 53 | DECITNLLV | BH3-interacting domain death agonist (BID) | P55957 |
| 54 | TVVSGSNVILN | CD48 antigen precursor (B-lymphocyte activation marker BLAST-1) | P09326 |
| 55 | SLDERPVAV | Bone morphogenetic protein receptor type-2 precursor (EC 2.7.11.30) | Q13873 |
| 56 | MVDSQQKSP | Bullous pemphigoid antigen 1, isoform 7 | Q8WXK8 |
| 57 | SLLLLPEKN | BRCA1 associated RING domain 1 variant | Q53F80 |
| 58 | VLCVSDIISL | Breast cancer type 2 susceptibility protein (Fanconi anemia group D1 protein) | P51587 |
| 59 | FLPDPSALQNL | Protein BRE (Brain and reproductive organ-expressed protein) (BRCA1/BRCA2-containing complex subunit 45) | Q9NXR7 |
| 60 | MLNEHDFEV | Breast cancer 1 early onset | Q3LRJ0 |
| 61 | VNTDFSPYL | Breast cancer 1 early onset | Q3LRJ0 |
| 62 | EFMLVYKFAR | Breast and ovarian cancer susceptibility protein | Q7KYU6 |
| 63 | TLWVDPYEV | BTG2 protein (NGF-inducible anti-proliferative protein PC3) | P78543 |
| 64 | FLDHIIASV | Nuclear protein 5qNCA | Q7LBC6 |
| 65 | TLNDREYQL | CAD protein [Includes: Glutamine-dependent carbamoyl-phosphate synthase (EC 6.3.5.5); Aspartate carbamoyl-transferase (EC 2.1.3.2); Dihydroorotase (EC 3.5.2.3)] | P27708 |
| 66 | VEVMVNDVN | Cadherin EGF LAG seven-pass G-type receptor 3 precursor (Flamingo homolog 1) (hFmi 1) (Multiple epidermal growth factor-like domains 2) (Epidermal growth factor-like 1) | Q9NYQ7 |
| 67 | LSIYLSIYL | Cadherin FIB3 | Q6UW70 |
| 68 | SLSMVNHRL | Integrin alpha-3 precursor (Galactoprotein B3) | P26006 |
| 69 | RVDFPGFVR | Calcineurin B homologous protein 2 (Hepatocellular carcinoma-associated antigen 520) | O43745 |
| 70 | MTDKAPPGV | Calcium/calmodulin-dependent protein kinase II inhibitor alpha (CaMKIINalpha) | Q7Z7J9 |
| 71 | WTNPQFKI | Calpain-11 (EC 3.4.22.-) | Q9UMQ6 |
| 72 | IMAQLPQEQKA | Alpha-1 catenin (Cadherin-associated protein) (Alpha E-catenin) | P35221 |
| 73 | KIDPLEVEE | Neural cell adhesion molecule variant | Q59FY0 |
| 74 | KLPEKWESV | Ribosomal L1 domain-containing protein 1 (Cellular senescence-inhibited gene protein) | O76021 |
| 75 | LIEKEKVLN | CENP-F kinetochore protein (Centromere protein F) (Mitosin) | P49454 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 76 | FEVKEDQVK | Centaurin-delta 1 (Cnt-d1) (Arf-GAP, Rho-GAP, ankyrin repeat and pleckstrin homology domain-containing protein 2) | Q8WZ64 |
| 77 | DTEAEKSQV | Centrosomal protein 2 (Centrosomal Nek2-associated protein 1) (C-NAP1) | Q9BV73 |
| 78 | FLKEHMDEV | Pericentriol material 1 | Q15154 |
| 79 | KLLGELHTL | Pericentriol material 1 | Q15154 |
| 80 | TLVEAFPTL | Cervical cancer suppressor gene 5 | Q8NFX8 |
| 81 | QSNKGFVVIN | T-complex protein 1 subunit zeta-2 | Q92526 |
| 82 | LADGALIYR | Chemokine-like factor (C32) | Q9UBR5 |
| 83 | GLGAEIEIR | Vacuolar protein sorting 13A | Q96RL7 |
| 84 | GKLILLDKL | Chromodomain-helicase-DNA-binding protein 2 (EC 3.6.1.-) | O14647 |
| 85 | PQTICRKP | FERM domain-containing protein 6 | Q96NE9 |
| 86 | RSYYLNEI | Putative protein C21orf56 | Q9H0A9 |
| 87 | TTITVSPFY | Adiponutrin (iPLA2-epsilon) | Q9NST1 |
| 88 | RLPDDDPTAV | Coatomer subunit gamma-2 | Q9UBF2 |
| 89 | LVAISTVSFSI | Sodium/potassium/calcium exchanger 2 precursor | Q9UI40 |
| 90 | VLIDYQRNV | Exportin-1 (Chromosome region maintenance 1 protein homolog) | O14980 |
| 91 | SILNEGGIK | CUB and sushi domain-containing protein 3 precursor | Q7Z407 |
| 92 | YMADRLLGV | Cullin-7 (CUL-7) | Q14999 |
| 93 | YLKDLIEEV | Cyclic AMP-dependent transcription factor ATF-4 | P18848 |
| 94 | YLDIKGLLD | S-phase kinase-associated protein 1A (Cyclin A/CDK2-associated protein p19) | P63208 |
| 95 | PCLSELHKA | Cyclin-A1 | P78396 |
| 96 | TVLDFGVLASI | Cyclin M3, isoform 1 | Q8NE01 |
| 97 | MPSETPQAE | Cystathionine beta-synthase human homolog of Cynomolgus monkey gene product | Q58H57 |
| 98 | FLLEALRKT | Cytochrome P450 2E1 (EC 1.14.14.1) | P05181 |
| 99 | KMLETKWSL | Keratin, type II cytoskeletal 8 | P05787 |
| 100 | QPLLKQSPW | CPEB2 protein | Q3B8N6 |
| 101 | YLLPAIVHI | Probable ATP-dependent RNA helicase DDX5 (EC 3.6.1.-) | P17844 |
| 102 | KLLPGDIHQI | Dedicator of cytokinesis protein 1 | Q14185 |
| 103 | SLLKGDLKGV | Development and differentiation-enhancing factor 2 | O43150 |
| 104 | NAEVLLVSEI | Probable ubiquitin carboxyl-terminal hydrolase FAF-Y (EC 3.1.2.15) | O00507 |
| 105 | RLWGEPVNL | Probable ubiquitin carboxyl-terminal hydrolase FAF-Y (EC 3.1.2.15) | O00507 |
| 106 | QLIDLSSPLI | G2 and S phase expressed protein 1 | Q9NYZ3 |
| 107 | YIDYTGAAYA | HUMAN CDNA FLJ30829 fis, clone FEBRA2001790, highly similar to Xenopus laevis RRM-containing protein SEB-4 mRNA | Q96NI3 |
| 108 | VIENKSDEKVI | KIAA1799 protein | Q96B95 |
| 109 | PSPQLWTV | Peroxisomal proliferator-activated receptor A-interacting complex 285 kDa protein (EC 3.6.1.-) (ATP-dependent helicase PRIC285) | Q9BYK8 |
| 110 | EGRGGLPAGLPV | HUMAN KIAA1922 | Q96PW6 |
| 111 | NMYGKVVTV | Transcription elongation factor SPT5 (DLC-1)(deleted in liver cancer-1) | O00267 |
| 112 | RLYDGLFKV | DNA damage-binding protein 1 (Damage-specific DNA-binding protein 1) | Q16531 |
| 113 | QNFVDSKEV | DNA excision repair protein ERCC-6 | Q03468 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent SwissProt Identification No. |
|---|---|---|---|
| 114 | ALIEKLVEL | DNA polymerase alpha subunit B (DNA polymerase alpha 70 kDa subunit) | Q14181 |
| 115 | VIEDDVNMAIR | DNA replication licensing factor MCM2 (Minichromosome maintenance protein 2 homolog) | P49736 |
| 116 | SQDEIKQEV | DNA2-like homolog (EC 3.6.1.-) (DNA replication ATP-dependent helicase-like homolog) | P51530 |
| 117 | HLNGSCHLLI | Estrogen response element binding protein (cotton-top Tarmarin), DNA2-like homolog (human) | Q77798 |
| 118 | ALIDRMVNL | DNA damage-inducible transcript 3 (DDIT-3) (Growth arrest and DNA-damage-inducible protein GADD153) | P35638 |
| 119 | SQKIQEAVKA | DNA-directed RNA polymerase I largest subunit (EC 2.7.7.6) | O95602 |
| 120 | LFDLVEEVQ | DnaJ homolog subfamily C member 1 | Q96KC8 |
| 121 | LLAALLLDP | Splice isoform 2 of P35462 | P35462-2 |
| 122 | FLDESRSTQYM | RuvB-like 2 (EC 3.6.1.-) (48-kDa TATA box-binding protein-interacting protein) | Q9Y230 |
| 123 | VLLGKVYVV | DRE1_protein | Q9NXT9 |
| 124 | TIDELKEQV | Dynactin-1 (150 kDa dynein-associated polypeptide) | Q14203 |
| 125 | NLAYENVKE | Dynein heavy chain, cytosolic (DYHC) | Q14204 |
| 126 | SEVEQYVKY | Dynein heavy chain, cytosolic (DYHC) | Q14204 |
| 127 | ETQLTYRR | Echinoderm microtubule associated protein-like 5 | Q6UYC9 |
| 128 | IKDDLEDLI | ECT2 protein (Epithelial cell-transforming sequence 2 oncogene) | Q9H8V3 |
| 129 | QVLGKIERA | Endothelial differentiation-related factor 1 (EDF-1) | O60869 |
| 130 | IQINLQRKM | Developmentally-regulated endothelial cell locus 1 protein) | O43854 |
| 131 | KLIEKLDIKL | Elongation factor 2 (EF-2) | P13639 |
| 132 | YLNEIKDSV | Elongation factor 2 (EF-2) | P13639 |
| 133 | YLAEKYEWDV | Elongation factor 2 (EF-2) | P13639 |
| 134 | VFEESQVAGT | Elongation factor 2 (EF-2) | P13639 |
| 135 | DAQKEIVRAQK | J domain protein C21orf55 | Q9NX36 |
| 136 | DLEETVFTAS | J domain protein C21orf55 | Q9NX36 |
| 137 | AMLEGGVDGLL | EMILIN-3 precursor (EMILIN-5) (Elastin microfibril interface-located protein 5) | Q9NT22 |
| 138 | RKADEKRIR | Synaptotagmin-like protein 4 (Exophilin-2) | Q96C24 |
| 139 | ALQEMVHQV | Enhancer of filamentation 1 (HEF1) | Q14511 |
| 140 | ILAINKPQNK | Enhancer of filamentation 1 (HEF1) | Q14511 |
| 141 | SMYGVDLHHA | Band 4.1-like protein 3 (4.1B) (Differentially expressed in adenocarcinoma of the lung protein 1) (DAL-1) | Q9Y2J2 |
| 142 | SEDITRYYL | Band 4.1-like protein 3 (4.1B) (Differentially expressed in adenocarcinoma of the lung protein 1) (DAL-1) | Q9Y2J2 |
| 143 | NQQEQEDLE | Epidermal growth factor receptor substrate 15 | P42566 |
| 144 | SKEEDPENV | Epidermal growth factor receptor substrate 15 | P42566 |
| 145 | FLDKQGFYV | Epidermal growth factor receptor substrate 15 (Protein Eps15) (AF-1p protein) | P42566 |
| 146 | TGALIYAIHA | Epithelial membrane protein 3 (EMP-3) (YMP protein) | P54852 |
| 147 | AVQVLMVLSL | Epithelial membrane protein 3 (EMP-3) (YMP protein) | P54852 |
| 148 | TLKEVEELEQL | Zyxin (Zyxin-2) | Q15942 |
| 149 | VLMTEDIKL | Eukaryotic translation initiation factor 4 gamma 1 | Q04637 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 150 | EEKKQKEMD | Eukaryotic translation initiation factor 4 gamma 1 | Q04637 |
| 151 | ELQALYALQAL | Eukaryotic translation initiation factor 4 gamma 1 | Q04637 |
| 152 | WSNKYDPPL | F-actin capping protein beta subunit | P47756 |
| 153 | NLSDLIDLV | F-actin capping protein beta subunit | P47756 |
| 154 | FLSHKLDIK | Protocadherin Fat 2 precursor (hFat2) (Multiple epidermal growth factor-like domains 1) | Q9NYQ8 |
| 155 | VEPALRKPP | Protocadherin Fat 2 precursor (hFat2) (Multiple epidermal growth factor-like domains 1) | Q9NYQ8 |
| 156 | QVVYSLPDSA | Protocadherin Fat 2 precursor (hFat2) (Multiple epidermal growth factor-like domains 1) | Q9NYQ8 |
| 157 | EKISSYQLK | Protocadherin Fat 2 precursor (hFat2) (Multiple epidermal growth factor-like domains 1) | Q9NYQ8 |
| 158 | EMDPQKMPYL | KIAA1752 protein | Q9C0B1 |
| 159 | VTNRARASKD | Fc alpha/mu receptor | Q8WWV6 |
| 160 | SMNLTISAGP | Fc alpha/mu receptor | Q8WWV6 |
| 161 | VTYLQNGKGR | Low affinity immunoglobulin gamma Fc region receptor III-A precursor (IgG Fc receptor III-2) | P08637 |
| 162 | ELLKTARSSK | FYVE, RhoGEF and PH domain-containing protein 2 (Zinc finger FYVE domain-containing protein 4) | Q7Z6J4 |
| 163 | LKEYIQKLP | FYVE, RhoGEF and PH domain-containing protein 2 (Zinc finger FYVE domain-containing protein 4) | Q7Z6J4 |
| 164 | YLNKLLITR | Fibroblast growth factor receptor-like 1 precursor (FGF receptor-like protein 1) | Q8N441 |
| 165 | IARPVGSSVR | Fibroblast growth factor receptor-like 1 precursor (FGF receptor-like protein 1) | Q8N441 |
| 166 | QCPVEGDPPPL | Fibroblast growth factor receptor-like 1 precursor (FGF receptor-like protein 1) | Q8N441 |
| 167 | TEDNVMKIA | Fibroblast growth factor receptor 4 precursor (EC 2.7.10.1) | P22455 |
| 168 | YLLDVLERS | Fibroblast growth factor receptor 4 precursor (EC 2.7.10.1) | P22455 |
| 169 | TASPDYLEI | Fibroblast growth factor receptor 2 precursor (EC 2.7.10.1) (FGFR-2) | P21802 |
| 170 | TENNVMKIA | Fibroblast growth factor receptor 2 precursor (EC 2.7.10.1) (FGFR-2) | P21802 |
| 171 | ETFKQIDMDND | FK506-binding protein 7 precursor (EC 5.2.1.8) | Q9Y680 |
| 172 | GLLELIEEP | Glomulin (FKBP-associated protein) (FK506-binding protein-associated protein) | Q92990 |
| 173 | FVEEVIDNK | Glomulin (FKBP-associated protein) (FK506-binding protein-associated protein) | Q92990 |
| 174 | LQLYINKLD | Glomulin (FKBP-associated protein) (FK506-binding protein-associated protein) | Q92990 |
| 175 | EQSLETTKV | FKSG73 | Q9BWW1 |
| 176 | VFNDELPASI | Flavin containing monooxygenase 3 isoform 2 variant | Q53FW5 |
| 177 | SLFPGKLEV | Protein flightless-1 homolog | Q13045 |
| 178 | QKKLVDTIE | Guanylate-binding protein 4 | Q96PP9 |
| 179 | DVGKDQEFTV | Filamin-A (Alpha-filamin) (Filamin-1) (Endothelial actin-binding protein) | P21333 |
| 180 | YLLKDKGEYTL | Filamin-A (Alpha-filamin) (Filamin-1) (Endothelial actin-binding protein) | P21333 |
| 181 | KTTDDIVKV | FLJ10101 protein | Q8WU94 |
| 182 | IEQERLER | CDNA FLJ14503 fis, clone NT2RM1000252, weakly similar to H. sapiens E- MAP-115 mRNA | Q96T17 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 183 | KINSAPSSPIK | E2F8 protein | Q5BKY4 |
| 184 | NNDICLDEV | Human Hypothetical protein | Q2VPJ3 |
| 185 | VFAEVGCSPC | HUMAN CDNA FLJ34154 fis, clone FCBBF3013058 | Q8NB70 |
| 186 | NIVETVLDL | Hypothetical protein FLJ43654 (Hypothetical protein C3orf62) | Q6ZUJ4 |
| 187 | IYIDGVQEVF | HUMAN CDNA FLJ46180 fis, clone TESTI4004031 | Q6ZRQ5 |
| 188 | KIMTEKELLAV | Flotillin-2 (Epidermal surface antigen) (ESA) | Q14254 |
| 189 | VEAQEILR | Flotillin-2 (Epidermal surface antigen) (ESA) | Q14254 |
| 190 | MLLDFIQHI | Serine/threonine-protein kinase ATR (EC 2.7.11.1) (Ataxia telangiectasia and Rad3-related protein) (FRAP-related protein 1) | Q13535 |
| 191 | SLLESVQKL | Serine/threonine-protein kinase ATR (EC 2.7.11.1) (Ataxia telangiectasia and Rad3-related protein) (FRAP-related protein 1) | Q13535 |
| 192 | YLQPKLLGI | Serine/threonine-protein kinase ATR (EC 2.7.11.1) (Ataxia telangiectasia and Rad3-related protein) (FRAP-related protein 1) | Q13535 |
| 193 | YLLVGTLFLL | Frizzled 5 precursor (Frizzled-5) | Q13467 |
| 194 | MAAGDYPEA | Frizzled 5 precursor (Frizzled-5) | Q13467 |
| 195 | LYLLVGTLFL | Frizzled 5 precursor (Frizzled-5) | Q13467 |
| 196 | ALSDHHVYL | Fructose-bisphosphate aldolase C (EC 4.1.2.13) | P09972 |
| 197 | YLAPHVRTL | G protein pathway suppressor 1 isoform 1 variant | Q53HS2 |
| 198 | YLQNWSHVL | G protein pathway suppressor 1 isoform 1 variant | Q53HS2 |
| 199 | FAALMLLGLV | KiSS-1 receptor (KiSS-1R) (Kisspeptins receptor) (Metastin receptor) (G-protein coupled receptor 54) | Q969F8 |
| 200 | MINLAVFDL | Probable G-protein coupled receptor 55 | Q9Y2T6 |
| 201 | EASALAVAPSAK | Probable G-protein coupled receptor 35 | Q9HC97 |
| 202 | TFVLTIILV | G-protein coupled receptor family C group 5 member C precursor (Retinoic acid-induced gene 3 protein) | Q9NQ84 |
| 203 | FLLDFEEDL | Leucine-rich repeat-containing G-protein coupled receptor 5 precursor (Orphan G-protein coupled receptor HG38) (G-protein coupled receptor 49) (G-protein coupled receptor 67) | O75473 |
| 204 | FAMDSYGTSN | Probable G-protein coupled receptor 133 precursor (G-protein coupled receptor PGR25) | Q6QNK2 |
| 205 | MELSEPIVEN | G1 to S phase transition protein 1 homolog (GTP-binding protein GST1-HS) | P15170 |
| 206 | WLENALGKL | Gamma-aminobutyric-acid receptor alpha-6 subunit precursor (GABA(A) receptor) | Q16445 |
| 207 | KILEHDDVSYL | Ganglioside-induced differentiation-associated protein 1-like 1 (GDAP1-L1) | Q96MZ0 |
| 208 | SQQNTDNLV | Gap junction alpha-5 protein (Connexin-40) (Cx40) | P36382 |
| 209 | SKLCEETPI | GEM-interacting protein (GMIP) | Q9P107 |
| 210 | QLVVELKDI | Golgin subfamily B member 1 (Giantin) | Q14789 |
| 211 | VFDIFQFAK | UDP-N-acetylhexosamine pyrophosphorylase (Antigen X) | Q16222 |
| 212 | NIANHFFTV | UDP-N-acetylhexosamine pyrophosphorylase (Antigen X) | Q16222 |
| 213 | HLIHEVTKV | Neutral alpha-glucosidase AB precursor (EC 3.2.1.84) | Q14697 |
| 214 | FLDPNNIPKA | Probable dolichyl pyrophosphate Glc1Man9GlcNAc2 alpha-1,3-glucosyltransferase (EC 2.4.1.-) | Q9BVK2 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 215 | KINEAVECLLSL | Bifunctional aminoacyl-tRNA synthetase [Includes: Glutamyl-tRNA synthetase (EC 6.1.1.17) (Glutamate--tRNA ligase); Prolyl-tRNA synthetase (EC 6.1.1.15) (Proline--tRNA ligase)] | P07814 |
| 216 | LLQTPKLLL | Glycoprotein nmb-like protein | Q8IXJ5 |
| 217 | VLLYSVVVV | Prolactin-releasing peptide receptor (PrRP receptor) (PrRPR) (G-protein coupled receptor 10) | P49683 |
| 218 | KFKQCKLLQ | G protein-coupled receptor 112 | Q5EGP2 |
| 219 | DVLSTSSAISL | G protein-coupled receptor 112 | Q5EGP2 |
| 220 | YIDDHSWTL | Growth factor receptor-bound protein 14 (GRB14 adapter protein) | Q14449 |
| 221 | SLYEENNKL | GRIP and coiled-coil domain-containing protein 2 (Golgi coiled coil protein GCC185) (CTCL tumor antigen se1-1) | Q8IWJ2 |
| 222 | KLLEVQILE | GRIP and coiled-coil domain-containing protein 2 (Golgi coiled coil protein GCC185) (CTCL tumor antigen se1-1) | Q8IWJ2 |
| 223 | KPLLEQKEL | GRIP and coiled-coil domain-containing protein 2 (Golgi coiled coil protein GCC185) (CTCL tumor antigen se1-1) | Q8IWJ2 |
| 224 | FPWELDPDWS | GROS1-L protein | Q9HC86 |
| 225 | YLSAAINPIL | Growth hormone secretagogue receptor type 1 (GHS-R) | Q92847 |
| 226 | QLSLADVILL | Glutathione S-transferase A4-4 (EC 2.5.1.18) | O15217 |
| 227 | QSFLVGNQL | Glutathione S-transferase A4-4 (EC 2.5.1.18) | O15217 |
| 228 | LKNKTKEAAE | GTP-binding protein Rhes (Ras homolog enriched in striatum) (Tumor endothelial marker 2) | Q96D21 |
| 229 | EDFHRKVYNI | GTP-binding protein Rhes (Ras homolog enriched in striatum) (Tumor endothelial marker 2) | Q96D21 |
| 230 | YIDDVFHAL | GTP-binding protein Rit1 (Ras-like protein expressed in many tissues) | Q92963 |
| 231 | EQLAELRQEF | VGFG2573 | Q6UY45 |
| 232 | GLLERVKEL | Hypothetical protein HDLBP | Q53QU2 |
| 233 | DAILRIVGE | Hypothetical protein HDLBP | Q53QU2 |
| 234 | RHKLVSDGQ | Heat shock protein 75 kDa, mitochondrial precursor (HSP 75) (Tumor necrosis factor type 1 receptor-associated protein) | Q12931 |
| 235 | IQLVMKVIE | Heat shock protein apg-1 | Q53ZP9 |
| 236 | MTREELVKN | Tumor rejection antigen (Gp96) 1 | Q5CAQ5 |
| 237 | ALKDKIEKA | Tumor rejection antigen (Gp96) 1 | Q5CAQ5 |
| 238 | KIILRHLIE | Heat-shock protein beta-3 (HspB3) (Heat shock 17 kDa protein) | Q12988 |
| 239 | TLGKLFWV | Low-density lipoprotein receptor-related protein S precursor | O75197 |
| 240 | KGQGGAGGQFL | Regulator of telomere elongation helicase 1 (EC 3.6.1.-) (Helicase-like protein NHL) | Q9NZ71 |
| 241 | KEFLVVASV | Hematopoietic protein 1 | Q52LW0 |
| 242 | KIAQKALDL | Heme oxygenase 1 (EC 1.14.99.3) (HO-1) | P09601 |
| 243 | ITEPLPELQL | Heparan sulfate glucosamine 3-O-sulfotransferase 5 (EC 2.8.2.23) | Q8IZT8 |
| 244 | KLRKEKEEF | Hepatocellular carcinoma-associated antigen 66 | Q9NYH9 |
| 245 | EDVFPNILN | Melanoma-associated antigen E2 (MAGE-E2 antigen) (Hepatocellular carcinoma-associated protein 3) | Q8TD90 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent SwissProt Identification No. |
|---|---|---|---|
| 246 | IAVMLLEGGAN | 26S proteasome non-ATPase regulatory subunit 10 (26S proteasome regulatory subunit p28) | O75832 |
| 247 | VDLFPGTFEV | Hepatocellular carcinoma-associated protein p28-II Hephaestin | Q5JUU1 |
| 248 | MVCGSPDIPL | HECT domain and RCC1-like domain-containing protein 2 (HERC2) | O95714 |
| 249 | DAPHSEGDMHLL | HECT domain and RCC1-like domain-containing protein 2 (HERC2) | O95714 |
| 250 | DTIEIITDR | Heterogeneous nuclear ribonucleoproteins A2/B1 (hnRNP A2/hnRNP B1) | P22626 |
| 251 | RLFVGSIPK | Heterogeneous nuclear ribonucleoprotein R (hnRNP R) | O43390 |
| 252 | FLSEYQHQP | HEXIM1 protein (HMBA-inducible) | O94992 |
| 253 | LALMISMISAD | Histatin-1 precursor (Histidine-rich protein 1) | Histatin-1 precursor (Histidine-rich protein 1) |
| 254 | RMLPHAPGV | Histone deacetylase 1 (HD1) | Q13547 |
| 255 | THNLLLNYGL | Histone deacetylase 1 (HD1) | Q13547 |
| 256 | SPNMNAVISL | Histone deacetylase 9 (HD9) (HD7B) (HD7) | Q9UKV0 |
| 257 | EFIDLLKKM | Homeodomain-interacting protein kinase 2 (EC 2.7.11.1) | Q9H2X6 |
| 258 | KMINHDSEKED | Cullin-2 (CUL-2) | Q13617 |
| 259 | AVDEDRKMYL | Cullin-2 (CUL-2) | Q13617 |
| 260 | LFELLEKEI | SWI/SNF-related matrix-associated actin-dependent regulator of chromatin subfamily A member 5 (EC 3.6.1.-) | O60264 |
| 261 | FISEFEHRV | HUMAN HSPC027 26S proteasome non-ATPase regulatory subunit 13 Synonyms 26S proteasome regulatory subunit S11 26S proteasome regulatory subunit p40.5 | Q9Y6E3 |
| 262 | AMFDHIPVGV | Hypothetical protein (Novel protein HSPC117) (DJ149A16.6 protein) (Hypothetical protein HSPC117) | Q9Y310 |
| 263 | WSFCLACV | Claudin domain-containing protein 1 (Membrane protein GENX-3745) Q9NY35 | Q9NY35 |
| 264 | NLLFPIIYL | Large neutral amino acids transporter small subunit 2 (L-type amino acid transporter 2) (hLAT2) | Q9UHI5 |
| 265 | SLLENLEKI | Heterogeneous nuclear ribonucleoprotein C-like 1 (hnRNP core protein C-like 1) | O60812 |
| 266 | ILDQKINEV | Ornithine decarboxylase (EC 4.1.1.17) (ODC) | P11926 |
| 267 | DQINIETKN | Regulator of nonsense transcripts 2 (Nonsense mRNA reducing factor 2) (Up-frameshift suppressor 2 homolog) (hUpf2) | Q9HAU5 |
| 268 | PFQNLLKEY | Regulator of nonsense transcripts 2 (Nonsense mRNA reducing factor 2) (Up-frameshift suppressor 2 homolog) (hUpf2) | Q9HAU5 |
| 269 | LELELENLEI | Regulator of nonsense transcripts 2 (Nonsense mRNA reducing factor 2) (Up-frameshift suppressor 2 homolog) (hUpf2) | Q9HAU5 |
| 270 | GLADASLLKKV | ATX10_HUMAN Ataxin-10 | Q9UBB4 |
| 271 | GQILEAAVSV | KIAA1833 protein | Q569G6 |
| 272 | RVVSVSFRV | HUMAN UDP-GalNAc: betaGlcNAc beta 1,3-galactosaminyltransferase, polypeptide 2 (Beta 1,3-N-acetylgalactosaminyltransferase-II) (MGC39558) | Q8NCR0 |
| 273 | TQKRLDVYL | Hypothetical protein KIAA1033 | Q2M389 |
| 274 | AMLTVLHEI | Activating signal cointegrator 1 complex subunit 3 (EC 3.6.1.-) | Q8N3C0 |
| 275 | ARLAALVQR | Delta-interacting protein A (Hepatitis delta antigen-interacting protein A) (Coiled-coil domain-containing protein 85B) | Q15834 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 276 | FAVHFYRS | Hypothetical protein FLJ14466 | Q96BP7 |
| 277 | FNITYLDID | Interferon-inducible double stranded RNA-dependent protein kinase activator A | O75569 |
| 278 | GLAKRVWSL | Hypothetical protein C9orf142 | Q9BUH6 |
| 279 | HLDATKLLL | Tetratricopeptide repeat protein 17 | Q96AE7 |
| 280 | IGSFHGVLSL | CDNA FLJ14058 fis, clone HEMBB1000554 | Q9H7Z0 |
| 281 | ILDLIDDAW | Anaphase promoting complex subunit 13 | Q9BS18 |
| 282 | KLLEMVRED | Hypothetical protein CCDC60 | Q8IWA6 |
| 283 | LSYLPATVEP | Sphingosine kinase 2 (EC 2.7.1.-) | Q9NRA0 |
| 284 | QLAQFVHEV | Probable ATP-dependent RNA helicase DDX11 (EC 3.6.1.-) (DEAD/H box protein 11) (CHL1 homolog) (Keratinocyte growth factor-regulated gene 2 protein) (KRG-2) | Q96FC9 |
| 285 | SYDESDEEE | Protein KIAA0182 | Q14687 |
| 286 | SYSDEFGPS | Ras GTPase-activating protein SynGAP (Synaptic Ras-GTPase-activating protein 1) (Synaptic Ras-GAP 1) (Neuronal RasGAP) | Q96PV0 |
| 287 | TVERADSSHLSI | Fibrinogen C domain containing 1 | Q8N539 |
| 288 | VTENELAVIT | MGC39581 protein | Q86XM0 |
| 289 | VTYLEDYSA | Bcl-2-like 13 protein (Mil1 protein) (Bcl-rambo) | Q9BXK5 |
| 290 | YLLEKTRVA | Myosin head domain containing 1 | Q96H55 |
| 291 | TLKILDLME | WD-repeat protein 51A | Q8NBT0 |
| 292 | EDLIKELIK | KIF27A (OTTHUMP00000021559) | Q86VH2 |
| 293 | LSLENLEKI | Inositol polyphosphate-5-phosphatase F, isoform 1 | Q2T9J4 |
| 294 | FLNKAADFIE | Myopalladin | Q96KF5 |
| 295 | GLDIDGIYRV | Rho GTPase activating protein 12 | Q5T2Y2 |
| 296 | QNNNLQTQI | Hypothetical protein DKFZp686D0630 | Q7Z3C5 |
| 297 | FLDDVVHSL | Jumonji domain-containing protein 1C (Thyroid receptor-interacting protein 8) (TRIP-8) | Q15652 |
| 298 | NMVDLNDY | Coatomer subunit beta (Beta-coat protein) (Beta-COP) | P53618 |
| 299 | YLLKEDMAGI | FLJ10462 fis, clone NT2RP1001494, weakly similar to MALE STERILITY PROTEIN 2 | Q9NVW8 |
| 300 | KLFEKVKEV | FLJ10462 fis, clone NT2RP1001494, weakly similar to MALE STERILITY PROTEIN 2 | Q9NVW8 |
| 301 | TVMDEIHTV | Cell-cycle and apoptosis regulatory protein 1 | Q6X935 |
| 302 | KLISELQKL | Telomere-associated protein RIF1 (Rap1-interacting factor 1 homolog) | Q5UIP0 |
| 303 | KVIDEIYRV | F-box only protein 28 | Q9NVF7 |
| 304 | SSLSDGLLLE | CDNA FLJ10901 fis, clone NT2RP5003524 | Q9NV65 |
| 305 | EEIVKVTFE | Acetoacetyl-CoA synthetase (EC 6.2.1.16) | Q86V21 |
| 306 | ELLENIIKN | Putative cell cycle control protein (DEP domain containing 1) | Q9NXZ0 |
| 307 | ELLSLVQNL | Synaptopodin 2-like | Q68A20 |
| 308 | PQQERDFY | CDNA FLJ36560 fis, clone TRACH2009340 | Q8N9T8 |
| 309 | GRGGKDPPLEP | CDNA FLJ13330 fis, clone OVARC1001802 | Q9H8Q0 |
| 310 | LADISLHDPV | ATP-dependent RNA helicase DDX31 (EC 3.6.1.-) (DEAD box protein 31) (Helicain) | Q9H8H2 |
| 311 | PSNMGIAIPL | Protein C14orf161 | Q9H7T0 |
| 312 | FMMPQSLGV | Cysteine protease ATG4B (EC 3.4.22.-) (Autophagy-related protein 4 homolog B) | Q9Y4P1 |
| 313 | IMVATAVVAI | CDNA FLJ14526 fis, clone NT2RM1001139 | Q96T08 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent SwissProt Identification No. |
|---|---|---|---|
| 314 | MTKRYEALE | Hypothetical protein CCDC77 (cDNA FLJ14732 fis, clone NT2RP3001969, weakly similar to TRICHOHYALIN) | Q9BR77 |
| 315 | SLDAKEIYL | CDNA FLJ14790 fis, clone NT2RP4000973, weakly similar to PROBABLE PROTEIN DISULFIDE ISOMERASE P5 (EC 5.3.4.1) | Q96K38 |
| 316 | QLLDIKTRL | Keratin 24 | Q2M215 |
| 317 | FLTDYLNDL | BCoR protein (BCL-6 corepressor) | Q6W2J9 |
| 318 | ANQGGFENGE | Hypothetical protein FLJ20582 | Q61Q21 |
| 319 | ILGLLLLHLE | Hypothetical protein FLJ22688 | Q9BT04 |
| 320 | VYQKEGVLAS | Hypothetical protein FLJ22944 | Q9H5W3 |
| 321 | YLNDFTHEI | Zinc finger protein, subfamily 1 A, 5- | Q8TBE5 |
| 322 | SPPLQGEIS | Leucine-rich repeats and IQ motif containing 2 | Q8IW35 |
| 323 | LFFEPVTTP | Hypothetical protein FLJ23749 | Q8TEA0 http://www.expasy.org/sprot/userman.html-AC_lineQ96LP1 |
| 324 | WISVPVVT | Hypothetical protein FLJ25336 | |
| 325 | NMEIMPEGSL | Hypothetical protein FLJ25660 | Q8N7G6 |
| 326 | QDQLSALQL | CDNA FLJ30058 fis, clone ADRGL2000074, weakly similar to RHO-GIPASE- ACTIVATING PROTEIN 6 | Q96NU6 |
| 327 | MEADPDLSR | CDNA FLJ30106 fis, clone BNGH41000190, weakly similar to *Rattus norvegicus* schlafen-4 (SLFN-4) mRNA. | Q96A82 |
| 328 | LYLPATTPY | Whirlin | Q9P202 |
| 329 | SEIEKNKKV | CDNA FLJ31846 fis, clone NT2RP7000425, weakly similar to MYOSIN HEAVY CHAIN, NONMUSCLE TYPE B | Q96MV0 |
| 330 | SLVQIVTTL | FLJ32833 fis, clone TESTI2003228 | Q96M43 |
| 331 | KILDIRKNV | Guanine nucleotide-binding protein G(olf), alpha subunit (Adenylate cyclase-stimulating G alpha protein, olfactory type) | P38405 |
| 332 | QSLELLLLPV | CDNA FLJ33811 fis, clone CTONG2002095 | Q8N279 |
| 333 | ALLNNIIEI | Transmembrane protein 16C | Q9BYT9 |
| 334 | FNQSSSLIIH | Zinc finger protein 31 (Zinc finger protein KOX29) (Zinc finger and SCAN domain-containing protein 20) (Zinc finger protein 360) | P17040 |
| 335 | LSLSALPVSY | Transmembrane 6 superfamily member 2 | Q9BZW4 |
| 336 | YLDLTPNQE | CDNA FLJ90251 fis, clone NT2RM4000115 | Q8NCH3 |
| 337 | YLFERIKEL | CDNA FLJ90251 fis, clone NT2RM4000115 | Q8NCH3 |
| 338 | FILDVLLPEA | CDNA FLJ90760 fis, clone THYRO1000061 | Q8N2I4 |
| 339 | EFIPEFEK | Tubulin--tyrosine ligase-like protein 12 | Q14166 |
| 340 | DVFPATPGSQN | KIAA0303 protein | O15021 |
| 341 | FIFDVHVHEV | Plexin-B2 precursor (MM1) | O15031 |
| 342 | ILEVTNNLE | Zinc finger and BTB domain-containing protein 5 | O15062 |
| 343 | ILSKKDLPL | Centrosome-associated protein 350 | Q8WY20 |
| 344 | HEPPKAVDK | piccolo (Aczonin) | Q9Y6V0 |
| 345 | ILDDSHLLV | KIAA0560 protein | O60306 |
| 346 | YLDNVVNKQ | KIAA0676 protein | Q96H49 |
| 347 | KLLPYVGLLQ | Human homolog of Mus SLIT and NTRK-like protein 5 precursor | Q8IOB7 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 348 | QLKSLIQID | Human homolog of Mus SLIT and NTRK-like protein 5 precursor | Q810B7 |
| 349 | SLLNNPLSI | Nischarin | Q6PIB4 |
| 350 | SSLSDALVLE | FERM domain-containing protein 4A | Q9P2Q2 |
| 351 | DELQQLFNL | Leucine-rich repeats neuronal protein 1 precursor (Neuronal leucine-rich repeat protein 1) (NLRR-1) | Q6UXK5 |
| 352 | QILSGRKPEL | KIAA1512 protein | Q9P216 |
| 353 | KLVEVIEEV | KIAA1598 protein | Q9HCH4 |
| 354 | QTLLKNPLY | hosphatidylinositol-3 phosphate 3-phosphatase adaptor subunit | Q96QU2 |
| 355 | SLLDDLHSA | KIAA1730 protein | Q9C0D3 |
| 356 | HILDSSIYS | KIAA1786 protein | Q96JN9 |
| 357 | QSSPPPPPPS | Hypothetical protein MGC20470 | Q9EK3 |
| 358 | LMCYAIMVT | OACT1 protein | Q86XC2 |
| 359 | FLSEEGGHVAV | 6-phosphofructo-2-kinase/fructose-2,6-biphosphatase 4 (6PF-2-K/Fru-2,6-P2ASE testis-type isozyme) | Q16877 |
| 360 | SPDQELVLL | IkappaB kinase complex-associated protein (IKK complex-associated protein) (p150) | O95163 |
| 361 | FLVVVLLKL | Immune receptor expressed on myeloid cells 2 | Q7Z7I3 |
| 362 | QIIEANYHS | High-affinity cAMP-specific and IBMX-insensitive 3,5-cyclic phosphodiesterase 8A (EC 3.1.4.17) | O60658 |
| 363 | ILIDKSGKLEL | Bone specific CMF608 | Q6WRI0 |
| 364 | TVMDSKIVQV | Importin alpha-7 subunit (Karyopherin alpha-6) | O60684 |
| 365 | VMDSKIVQV | Importin alpha-7 subunit (Karyopherin alpha-6) | O60684 |
| 366 | YQDPLDPTRSV | InaD-like protein (Inadl protein) (hINADL) (Pals1-associated tight junction protein) (Protein associated to tight junctions) | Q8NI35 |
| 367 | HEFLTPRL | InaD-like protein (Inadl protein) (hINADL) (Pals1-associated tight junction protein) (Protein associated to tight junctions) | Q8NI35 |
| 368 | GLFPWTPKL | InaD-like protein (Inadl protein) (hINADL) (Pals1-associated tight junction protein) (Protein associated to tight junctions) | Q8NI35 |
| 369 | CDVQRYNI | Nitric oxide synthase, inducible (EC 1.14.13.39) | P35228 |
| 370 | NMYGKVVTV | Transcription elongation factor SPT5 (hSPT5) | O00267 |
| 371 | QNVQVNQKV | Inositol-trisphosphate 3-kinase B (EC 2.7.1.127) (Inositol 1,4,5-trisphosphate 3-kinase B) | P27987 |
| 372 | SLINQMTQV | Type I inositol-3,4-bisphosphate 4-phosphatase (EC 3.1.3.66) (Inositol polyphosphate 4-phosphatase type I) | Q96PE3 |
| 373 | NVTVAVPTV | Insulin receptor beta subunit | Q9UCB7 |
| 374 | LGLENLCHL | Insulin-like growth factor binding protein, acid labile subunit | Q8TAY0 |
| 375 | YYEKLHTYF | Integrin beta-4 precursor (GP150) (CD104 antigen) | P16144 |
| 376 | LLAALLLDP | Splice isoform 2 of P35462 | P35462-2 |
| 377 | RRDFGFPQ | Interferon alpha 2 protein | Q16055 |
| 378 | SLLGFVYKL | Interferon-induced protein with tetratricopeptide repeats 1 (IFIT-1)) (Interferon-induced 56 kDa protein) (IFI-56K) | P09914 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 379 | LDRVFKNY | Interleukin-20 precursor (IL-20) (Four alpha helix cytokine Zcyto10) | Q9NYY1 |
| 380 | LMVDHVTEV | Steroid receptor RNA activator isoform 1 | Q9HD15 |
| 381 | KMDQQEFSI | Intersectin-2 (SH3 domain-containing protein 1B) (SH3P18) (SH3P18-like WASP-associated protein) | Q9NZM3 |
| 382 | SLLLLPEEL | ITI-like protein (Inter-alpha (Globulin) inhibitor H5-like) | Q6UXX5 |
| 383 | SQQNTDNLV | Gap junction alpha-5 protein (Connexin-40) | P36382 |
| 384 | WLDETLAQV | Kelch-like protein 8 | Q9P2G9 |
| 385 | VNLGGSKSISIS | Keratin, type II cytoskeletal 1 (Cytokeratin-1) | P04264 |
| 386 | ANYLDSMYI | ADAM 9 precursor (EC 3.4.24.-) (A disintegrin and metalloproteinase domain 9) (Metalloprotease/disintegrin/cysteine-rich protein 9) (Myeloma cell metalloproteinase) | Q13443 |
| 387 | HLWNSIHGL | Next to BRCA1 gene 1 protein (Neighbor of BRCA1 gene 1 protein) (Membrane component, chromosome 17, surface marker 2) (1A1-3B) | Q14596 |
| 388 | SLADLMPRV | Hypothetical protein DKFZp686K2075 | Q6MZZ8 |
| 389 | IDLSASLVLN | KIAA0100 protein | Q14667 |
| 390 | HLTYLNVYL | Pre-mRNA-splicing factor ATP-dependent RNA helicase PRP16 (EC 3.6.1.-) (ATP-dependent RNA helicase DHX38) (DEAH box protein 38) | Q92620 |
| 391 | QLVACIESKL | KIAA0251 protein | Q8TBS5 |
| 392 | EGKLVVQDIE | HUMAN KIAA0342 protein | O15050 |
| 393 | QALEAGAVVLI | KIAA0357 protein | O15064 |
| 394 | VLSCSQALKI | Hypothetical protein KIAA0372 | Q6PGP7 |
| 395 | LSIEGEQEL | KIAA0377 splice variant 2 | Q86TE7 |
| 396 | EFQDLNQEV | KIAA0386 protein | Q9Y4F9 |
| 397 | RTKLTDIQI | HUMAN CTCL tumor antigen HD-CL-04 | Q548S1 |
| 398 | RECKYDLPP | Importin-13 (Imp13) (Ran-binding protein 13) | O94829 |
| 399 | QLTKIQTEL | KIAA0769 protein | O94868 |
| 400 | LVNAAQSVFV | Hypothetical protein KIAA0863 | Q61Q32 |
| 401 | VKAEDKARV | Zinc finger protein KIAA1196- | Q96KM6 |
| 402 | VLHDRIVSV | CRSP complex subunit 3 (Cofactor required for Sp1 transcriptional activation subunit 3) (Transcriptional co-activator CRSP130) (Vitamin D3 receptor-interacting protein complex | Q9ULK4 |
| 403 | RNSIATLQGGR | 130 kDa component [Pyruvate dehydrogenase [lipoamide]]-phosphatase 2, mitochondrial precursor (EC 3.1.3.43) | Q9P2J9 |
| 404 | TVNILIVDQN | Protocadherin-10 precursor | Q9P2E7 |
| 405 | YLFDLPLKV | Leucine-rich repeats and calponin homology (CH) domain containing 2 | Q5VUJ6 |
| 406 | NLAKDNEVL | Ankyrin repeat domain 18B | Q5W0G2 |
| 407 | SGDKLKLDQT | Kin17 protein (HsKin17 protein) (KIN, antigenic determinant of recA protein homolog) | O60870 |
| 408 | KLTDYQVTL | Kinesin-like protein KIF13A (Kinesin-like protein RBKIN) | Q9H1H9 |
| 409 | KIQEILTQV | Putative RNA binding protein KOC | O00425 |
| 410 | YLDEQIKKV | HUMAN Kinesin-like protein KIF13A (Kinesin-like protein RBKIN) | Q9H1H9 |
| 411 | SSIWEVDSLH | HUMAN Kinesin-like protein KIF13A (Kinesin-like protein RBKIN) | Q9H1H9 |
| 412 | RLASYLDRV | Keratin, type I cytoskeletal 18 (Cytokeratin-18) | P05783 |
| 413 | ALLNIKVKL | Keratin, type I cytoskeletal 18 (Cytokeratin-18) | P05783 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 414 | FNIVKNKTE | Kv3.2d voltage-gated potassium channel | Q86W09 |
| 415 | KAITAPVSL | Lethal(3)malignant brain tumor-like protein (L(3)mbt-like) (L(3)mbt protein homolog) | Q9Y468 |
| 416 | HEYLKAFKV | Lactadherin precursor (Milk fat globule-EGF factor 8) (MFG-E8) (HMFG) (Breast epithelial antigen BA46) (MFGM) | Q08431 |
| 417 | LKAFKVAYS | Lactadherin precursor (Milk fat globule-EGF factor 8) (MFG-E8) (HMFG) (Breast epithelial antigen BA46) (MFGM) | Q08431 |
| 418 | RLAVYIDRV | Lamin-A/C (70 kDa lamin) | P02545 |
| 419 | YLLGNSSPRT | Lamin-A/C (70 kDa lamin) | P02545 |
| 420 | EMKVSDLDR | Laminin gamma-1 chain precursor (Laminin B2 chain) | P11047 |
| 421 | VRLVDAGGVKL | Low-density lipoprotein receptor-related protein 5 precursor | O75197 |
| 422 | KPETFEHLF | Leptin receptor precursor (LEP-R) (OB receptor) | P48357 |
| 423 | EITDDGNLK | Leptin receptor precursor (LEP-R) (OB receptor) | P48357 |
| 424 | ECHHRYAEL | Leptin receptor precursor (LEP-R) (OB receptor) | P48357 |
| 425 | PSTCPDGFKI | Mitogen-activated protein kinase kinase kinase 13 (EC 2.7.11.25) | O43283 |
| 426 | RKGIIDVNL | Leukemia virus receptor 2 | Q08357 |
| 427 | LIQERDVKK | Leukemia-associated protein with a CXXC domain | Q8NFU7 |
| 428 | LTLEQVVAIE | Leukemia-associated protein with a CXXC domain | Q8NFU7 |
| 429 | RDTPHSDFRG | RNA-binding protein 6 (RNA-binding motif protein 6) (RNA-binding protein DEF-3) (Lung cancer antigen NY-LU-12) | P78332 |
| 430 | HRVLLHLF | Lung cancer oncogene 5 | Q7Z5Q7 |
| 431 | LLFDRPMHV | Heterogeneous nuclear ribonucleoprotein M (hnRNP M) | P52272 |
| 432 | FLSELTQQL | Macrophage migration inhibitory factor (MIF) (Phenylpyruvate tautomerase) (EC 5.3.2.1) | P14174 |
| 433 | SLLSHVEQL | Mitotic spindle assembly checkpoint protein MAD2B (MAD2-like 2) (hREV7) | Q9UI95 |
| 434 | KLILRLHKL | Mitogen-activated protein kinase kinase kinase 4 (EC 2.7.11.25) (MAPK/ERK kinase kinase 4) | Q9Y6R4 |
| 435 | RLTHHPVYI | Serine/threonine/tyrosine-interacting-like protein 1 (Dual-specificity protein phosphatase 24) (Map kinase phosphatase-like protein MK-STYX) | Q9Y6J8 |
| 436 | QDNLEKLLQ | Microtubule-associated serine/threonine-protein kinase 2 (EC 2.7.11.1) | Q6P0Q8 |
| 437 | MKRLLLLF | Matrix metalloprotease MMP-27 | Q9H306 |
| 438 | DPQDILEVK | MCM10 protein | Q7L590 |
| 439 | FLFGEVHKA | MCM10 protein | Q7L590 |
| 440 | KVIVLVNKVLL | Interferon-induced helicase C domain-containing protein 1 (EC 3.6.1.-) (Melanoma differentiation-associated protein 5) | Q9BYX4 |
| 441 | QILSLEEKI | Melanoma ubiquitous mutated protein | Q2TAK8 |
| 442 | MLKDIIKEY | Melanoma antigen family D, 2 | Q5BJF3 |
| 443 | KTWGQYWQV | Melanocyte protein Pmel 17 precursor (Melanocyte lineage-specific antigen GP100) | P40967 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent SwissProt Identification No. |
|---|---|---|---|
| 444 | LLDGTATLRL | Melanocyte protein Pmel 17 precursor (Melanocyte lineage-specific antigen GP100) | P40967 |
| 445 | VLKEIVERV | GPI-anchored protein p137 (p137GPI) (Membrane component chromosome 11 surface marker 1) Cytoplasmic activation/proliferation-associated protein 1 | Q14444 |
| 446 | SLLDEFYKL | GPI-anchored protein p137 (p137GPI) (Membrane component chromosome 11 surface marker 1) Cytoplasmic activation/proliferation-associated protein 1 | Q14444 |
| 447 | TLNQNGYTLV | Hepatocyte growth factor receptor precursor (EC 2.7.10.1) (HGF receptor) (Scatter factor receptor) (SF receptor) (HGF/SF receptor) (Met proto-oncogene tyrosine kinase) | P08581 |
| 448 | QMPKMNFAN | Mitogen-activated protein kinase 14 (EC 2.7.11.24) | Q16539 |
| 449 | KLADFGVSGE | Mitogen-activated protein kinase kinase kinase 2 (EC 2.7.11.1) (MAPK/ERK kinase kinase kinase 2) | Q12851 |
| 450 | SIKDYEQAN | Mitotic kinesin-related protein | Q96Q89 |
| 451 | EDLMEDEDL | Mitotic kinesin-related protein | Q96Q89 |
| 452 | VLISKELISL | Sperm-associated antigen 5 (Astrin) (Mitotic spindle-associated protein p126) | Q96R06 |
| 453 | LIEKVQEAR | Myeloid/lymphoid or mixed-lineage leukemia protein 4 (Trithorax homolog 2) | Q9UMN6 |
| 454 | SRVRMKTPT | Myeloid/lymphoid or mixed-lineage leukemia protein 4 (Trithorax homolog 2) | Q9UMN6 |
| 455 | GLDDIKDLKV | Putative helicase MOV-10 (EC 3.6.1.-) (Moloney leukemia virus 10 protein) | Q9HCE1 |
| 456 | VLAETLTQV | MOZ/CBP protein | Q712H6 |
| 457 | DTNADKQLS | Calgranulin B (Migration inhibitory factor-related protein 14) (MRP-14) (P14) | P06702 |
| 458 | GRWVCKDLPCP | MUC2_HUMAN Mucin-2 precursor (Intestinal mucin 2) | Q02817 |
| 459 | FGNMQKINQ | MUC2_HUMAN Mucin-2 precursor (Intestinal mucin 2) | Q02817 |
| 460 | FPNWTLAQV | Mucin-5B precursor (Mucin 5 subtype B, tracheobronchial) | Q9HC84 |
| 461 | ATPSSTPETV | Mucin-5B precursor (Mucin 5 subtype B, tracheobronchial) | Q9HC84 |
| 462 | FVNDVNLEN | Multiple PDZ domain protein (Multi PDZ domain protein 1) (Multi-PDZ-domain protein 1) | O75970 |
| 463 | SENKLILMK | RUFY2 (Run and FYVE domain-containing protein Rabip4 | Q8IW33 |
| 464 | TFCVQPGEKV | Multidrug resistance-associated protein 7 | Q8NHX7 |
| 465 | YLNDGLWHM | Multiple copies in a T-cell malignancies (Malignant T cell amplified sequence 1) (MCT1) | Q9ULC4 |
| 466 | GTTLRNLEI | DNA mismatch repair protein Msh3 | P20585 |
| 467 | SPPTLNGAPSP | Protein CBFA2T2 (MTG8-like protein) (MTG8-related protein 1) (Myeloid translocation-related protein 1) | O43439 |
| 468 | NEAAIKNVYL | Myomesin-1 (190 kDa titin-associated protein) (190 kDa connectin-associated protein | P52179 |
| 469 | FIDFGMDLQ | Myosin heavy chain, cardiac muscle beta isoform (MyHC-beta) | P12883 |
| 470 | LLEAKVKEL | Myosin-13 (Myosin heavy chain, skeletal muscle, extraocular) (MyHC-eo) | Q9UKX3 |
| 471 | LLAEKVEQL | Tumor suppressor candidate 3 (N33 protein) | Q13454 |
| 472 | LANARGLGLQ | Nebulin-related anchoring protein | Q8TCH0 |
| 473 | VNRIGQESLE | Neural cell adhesion molecule 1, 1 | P13592 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent SwissProt Identification No. |
|---|---|---|---|
| 474 | YLEIQGITR | Neurotrimin precursor | Q9P121 |
| 475 | EALENNKEL | Ninein | Q8N4C6 |
| 476 | NSMVVERQQL | Ninein | Q8N4C6 |
| 477 | HLLERVDQV | Ninein | Q8N4C6 |
| 478 | PERTQLLYL | Notch homolog 2 | Q5VTD0 |
| 479 | NGGTCEDGIN | Neurogenic locus notch homolog protein 1 precursor (Notch 1) (hN1) (Translocation-associated notch protein TAN-1) [Contains: Notch 1 extracellular truncation; Notch 1 intracellular domain] | P46531 |
| 480 | QSAADYLGAL | Neurogenic locus notch homolog protein 3 precursor (Notch 3) [Contains: Notch 3 extracellular truncation; Notch 3 intracellular domain] | Q9UM47 |
| 481 | ALLVVLSPPAL | Neurogenic locus notch homolog protein 4 precursor (Notch 4) (hNotch4) [Contains: Notch 4 extracellular truncation; Notch 4 intracellular domain]- | Q99466 |
| 482 | LRLDXLFKL | Plexin-A1 precursor (Semaphorin receptor NOV) | Q9UIW2 |
| 483 | WLIEDGKVV | HUMAN NPD011 | Q9H2R7 |
| 484 | SQPQEPENK | Nuclear autoantigen Sp-100 (Speckled 100 kDa) (Nuclear dot-associated Sp100 protein) | P23497 |
| 485 | LLREKVEFL | Nuclear factor erythroid 2-related factor 1 (NF-E2-related factor 1) (NFE2-related factor 1) (Nuclear factor, erythroid derived 2, like 1) (Transcription factor 11) (Transcription factor HBZ17) (Transcription factor LCR-F1) (Locus control region-factor 1) | Q14494 |
| 486 | YLDDVNEII | Nuclear factor of activated T-cells, cytoplasmic 1 (NFAT transcription complex cytosolic component) (NF-ATc1) | O95644 |
| 487 | ALLDQLYLA | Nuclear receptor coactivator 2 (NCoA-2) (Transcriptional intermediary factor 2) | Q15596 |
| 488 | TLFDYEVRL | Ubiquitin-like PHD and RING finger domain-containing protein 1 (EC 6.3.2.-) | Q96T88 |
| 489 | SILKVVINN | Nucleic acid helicase DDXx | Q8IWW2 |
| 490 | LLYGGDLHSA | Nucleic acid helicase DDXx | Q8IWW2 |
| 491 | KLAENIDAQL | Nucleoporin 62 kDa (NUP62 protein) | Q6GTM2 |
| 492 | SLLTDEEDVD | Nuclear pore complex protein Nup98-Nup96 precursor [Contains: Nuclear pore complex protein Nup98 (Nucleoporin Nup98) (98 kDa nucleoporin); | P52948 |
| 493 | VDITQEPVL | Nuclear pore complex protein Nup98-Nup96 precursor [Contains: Nuclear pore complex protein Nup98 (Nucleoporin Nup98) (98 kDa nucleoporin); | P52948 |
| 494 | QLEKKLME | Nucleoprotein TPR | P12270 |
| 495 | GLDPLGYEIQ | Nuclear pore complex protein Nup107 | P57740 |
| 496 | ALLDRIVSV | Nuclear pore complex protein Nup205 | Q92621 |
| 497 | KILDLETQL | ODF2 protein | Q6PJQ8 |
| 498 | VTWLKETEV | Trophoblast glycoprotein precursor (5T4 oncofetal trophoblast glycoprotein) | Q6PJQ8 |
| 499 | VDLPGVINTV | Dynamin-like 120 kDa protein, mitochondrial precursor (Optic atrophy 1 gene protein) | O60313 |
| 500 | TITCLPATLV | Orexin receptor type 2 (Ox2r) (Hypocretin receptor type 2) | O43614 |
| 501 | LLGPRLVLA | Transmembrane emp24 domain-containing protein 10 precursor (Transmembrane protein Tmp21) | P49755 |
| 502 | LTTPDAAGVNQ | Orphan nuclear receptor TR2 (Testicular receptor 2) | P13056 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 503 | FLDGHDLQL | MKL/myocardin-like protein 1 (Myocardin-related transcription factor A) (MRTF-A) (Megakaryoblastic leukemia 1 protein) (Megacaryocytic acute leukemia protein) | Q969V6 |
| 504 | KTTEVLDASA | Ovarian cancer related tumor marker CA125- | Q8WXI7 |
| 505 | TSPTVPWTTSIF | Ovarian cancer related tumor marker CA125- | Q8WXI7 |
| 506 | WTITDTTEH | Ovarian cancer related tumor marker CA125- | Q8WXI7 |
| 507 | TITNLQYGE | Ovarian cancer related tumor marker CA125- | Q8WXI7 |
| 508 | ARLTFLNRG | Oxysterol-binding protein-related protein 8 (OSBP-related protein 8) | Q9BZF1 |
| 509 | KIDALSSEKL | Centrosomal protein of 70 kDa (Cep70 protein) (p10-binding protein) | Q8NHQ1 |
| 510 | LLAEAVLTYL | Leucine carboxyl methyltransferase 2 (EC 2.1.1.-) (p21WAF1/CIP1 promoter-interacting protein) | O60294 |
| 511 | SLFEKGLKNV | F-box/LRR-repeat protein 5 (F-box and leucine-rich repeat protein 5) (F-box protein FBL4/FBL5) | Q9UKA1 |
| 512 | LDTPSQPVNN | Inhibitor of growth protein 3 | Q9NXR8 |
| 513 | VLDELKNMKC | P53 inducible protein | Q9UN29 |
| 514 | PQDYPDKKSLP | DNA polymerase alpha catalytic subunit (EC 2.7.7.7) | P09884 |
| 515 | NLLPKLHIV | Chloride intracellular channel protein 4 (Intracellular chloride ion channel protein p64H1 | Q9Y696 |
| 516 | LAAAGGPGQGWA | Paired mesoderm homeobox protein 2B (Paired-like homeobox 2B) (PHOX2B homeodomain protein) (Neuroblastoma Phox) | Q99453 |
| 517 | GTPPPPGKPE | PRB3 protein | P81489 |
| 518 | SQGAVGLAGV | Protein patched homolog 1 (PTC1) (PTC) | Q13635 |
| 519 | ELKKINYQV | Protein patched homolog 1 (PTC1) (PTC) | Q13635 |
| 520 | KLFQDLQDL | Rap guanine nucleotide exchange factor 2 (Neural RAP guanine nucleotide exchange protein) (nRap GEP) (PDZ domain-containing guanine nucleotide exchange factor 1) (PDZ-GEF1) | Q9Y4G8 |
| 521 | EAIVSHEKN | Pecanex-like protein 1 (Pecanex homolog) | Q96RV3 |
| 522 | GLLPQVNTFV | Pecanex-like protein 1 (Pecanex homolog)- | Q96RV3 |
| 523 | KAYDVEREL | GC-1-related estrogen receptor alpha coactivator short isoform | Q8TDE4 |
| 524 | DVLESWLDF | PHD finger | Q86U89 |
| 525 | TMLVLVIRG | Hypothetical protein DKFZp686C07187 | Q6N038 |
| 526 | DVAQLQALLQ | Phosphatidylinositol-4,5-bisphosphate 3-kinase catalytic subunit beta isoform (EC 2.7.1.153) (PI3-kinase p110 subunit beta) (PtdIns-3-kinase p110) | P42338 |
| 527 | QIIEANYHS | Phosphodiesterase 8A, isoform 1 | Q6P9H3 |
| 528 | YVTDVLYRV | Serine/threonine-protein kinase SMG1 (EC 2.7.11.1) (SMG-1) (hSMG-1) (Lambda/iota protein kinase C-interacting protein) (Lambda-interacting protein) ( | Q96Q15 |
| 529 | FLDDEVIEL | PiggyBac transposable element derived 3 | Q8N328 |
| 530 | VICILPNDDK | PIWIL3 protein | Q7Z3Z3 |
| 531 | IQNSQLQLQ | Homeobox protein PKNOX1 (PBX/knotted homeobox 1) | P55347 |
| 532 | FAYLLTYMA | Transmembrane protein 115 (Protein PL6) | Q12893 |
| 533 | GLIDSLVHYV | Plakophilin-2 | Q99959 |
| 534 | REDHPARP | Plectin 6 | Q6S380 |
| 535 | FLLDPVKGERL | Plectin 1 (PLTN) (PCN) (Hemidesmosomal protein 1) (HD1) | Q15149 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 536 | RGQNLDVVQ | Plexin B1; plexin 5; semaphorin receptor | O43157 |
| 537 | SLTGHISTV | Pleiotropic regulator 1 | O43660 |
| 538 | EPLRVPPDL | Blood vessel epicardial substance (hBVES) (Popeye domain-containing protein 1) (Popeye protein 1) | Q8NE79 |
| 539 | EIPVLNELPV | Carboxypeptidase-like protein X2 precursor | Q8N436 |
| 540 | LYIPAMAFI | YIF1B protein | YIF1B protein |
| 541 | SLLQHLIGL | Melanoma antigen preferentially expressed in tumors (Pr4eferentially expressed antigen of melanoma) (OPA-interacting protein 4) | P78395 |
| 542 | ISSMLVLFF | Splice isoform 2 of Q9H7F0 | Q9H7F0-2 |
| 543 | ENHSSQTDNI | P2Y purinoceptor 13 (P2Y13) (G-protein coupled receptor 86) (G-protein coupled receptor 94) | Q9BPV8 |
| 544 | ILMGVLKEV | Putative pre-mRNA-splicing factor ATP-dependent RNA helicase DHX15 (EC 3.6.1.-) (DEAH box protein 15) (ATP-dependent RNA helicase #46) | O43143 |
| 545 | VLFENTDSVHL | HUMAN RNA-binding protein 34 (RNA-binding motif protein 34) | P42696 |
| 546 | INMRIQDL | Prolyl 4-hydroxylase alpha-1 subunit precursor (EC 1.14.11.2) (4-PH alpha-1) (Procollagen-proline,2-oxoglutarate-4-dioxygenase alpha-1 subunit) | P13674 |
| 547 | KTDKTLVLL | Profilin-1 | P07737 |
| 548 | GLIEILKKV | Programmed cell death protein 5 (TFAR19 protein) (IF-1 cell apoptosis-related gene 19 protein) | O14737 |
| 549 | NMVDIIHSV | Propionyl-CoA carboxylase beta chain, mitochondrial precursor (EC 6.4.1.3) | P05166 |
| 550 | ILDAGGHNVTI | 26S proteasome non-ATPase regulatory subunit 1 (26S proteasome regulatory subunit RPN2) (26S proteasome regulatory subunit S1) (26S proteasome subunit p112) | Q99460 |
| 551 | YMNLEKPDFI | 26S proteasome non-ATPase regulatory subunit 1 (26S proteasome regulatory subunit RPN2) (26S proteasome regulatory subunit S1) (26S proteasome subunit p112) | Q99460 |
| 552 | SLADIAQKL | 26S proteasome non-ATPase regulatory subunit 3 (26S proteasome regulatory subunit S3) (Proteasome subunit p58) | O43242 |
| 553 | QLVDIIEKV | Proteasome activator complex subunit 3 (Proteasome activator 28-gamma subunit) (PA28gamma) (PA28g) (Activator of multi-catalytic protease subunit 3) (11S regulator complex gamma subunit) (REG-gamma) (Ki nuclear autoantigen) | P61289 |
| 554 | SLLKVDQEV | Proteasome activator complex subunit 3 (Proteasome activator 28-gamma subunit) (PA28gamma) (PA28g) (Activator of multi-catalytic protease subunit 3) (11S regulator complex gamma subunit) (REG-gamma) (Ki nuclear autoantigen) | P61289 |
| 555 | QILRLLHIE | Protein C14orf166 | Q9Y224 |
| 556 | EMGGGENNLK | Protein KIAA1219 | Q86X10 |
| 557 | NLAEKLIGV | Protein KIAA1219 | Q86X10 |
| 558 | EKSVSVQTNL | Protein KIAA1688 | Q9COH5 |
| 559 | GLLDSLTGILN | Protein Plunc precursor (Palate lung and nasal epithelium clone protein) (Lung-specific protein X) (Nasopharyngeal carcinoma-related protein) (Tracheal epithelium-enriched protein) (Secretory protein in upper respiratory tracts) | Q9NP55 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 560 | SLLPPDALVGL | Protein transport protein Sec23B | Q15437 |
| 561 | LEEKNTLIQEL | Liprin-alpha-2 (Protein tyrosine phosphatase receptor type f polypeptide-interacting protein alpha-2) (PTPRF-interacting protein alpha-2) | O75334 |
| 562 | LLSESNERL | Liprin-alpha-2 (Protein tyrosine phosphatase receptor type f polypeptide-interacting protein alpha-2) (PTPRF-interacting protein alpha-2) | O75334 |
| 563 | LADLGSLESP | Protocadherin gamma A12 precursor (PCDH-gamma-A12) (Cadherin-21) (Fibroblast cadherin 3) | O60330 |
| 564 | QLLKFQLNK | Protocadherin gamma A10 precursor (PCDH-gamma-A10) | Q9Y5H3 |
| 565 | LLAEAVLTYL | Leucine carboxyl methyltransferase 2 (EC 2.1.1.-) (p21WAF1/CIP1 promoter-interacting protein) | O60294 |
| 566 | QLLREPHLQ | KIAA1636 protein | Q9HCD6 |
| 567 | TIPNLEQIE | Probable G-protein coupled receptor 160 | Q9UJ42 |
| 568 | KLWEAESKL | Protein C21orf45 | Q9NYP9 |
| 569 | IFHLHELPE | Periodic tryptophan protein 2 homolog | Q15269 |
| 570 | KLFNDAIRL | Rab-like protein 2B | Q9UNT1 |
| 571 | FENQEVQAI | Cell cycle checkpoint protein RAD17 (hRad17) (RF-C/activator 1 homolog) | O75943 |
| 572 | EYVEKFYRI | DNA repair protein RAD50 (EC 3.6.-.-) (hRAD50) | Q92878 |
| 573 | QIDEIRDK | DNA repair protein RAD50 (EC 3.6.-.-) (hRAD50) | Q92878 |
| 574 | FLHEKLESL | Ras GTPase-activating protein 1 (GTPase-activating protein) (GAP) (Ras p21 protein activator) (p120GAP) (RasGAP) | P20936 |
| 575 | FELNNELKM | Ras guanine nucleotide exchange factor 2 | Q9UK56 |
| 576 | LLSNNNQAL | Ras-GTPase-activating protein-binding protein 1 (EC 3.6.1.-) (ATP-dependent DNA helicase VIII) (GAP SH3-domain-binding protein 1) (G3BP-1) (HDH-VIII) | Q13283 |
| 577 | VLCGNKSDLE | Ras-related protein Rab-27A (Rab-27) (GTP-binding protein Ram) | P51159 |
| 578 | LLMYDIAN | Ras-related protein Rab-3D | O95716 |
| 579 | SQVNILSKIVSR | Nuclear pore complex protein Nup107 (Nucleoporin Nup107) (107 kDa nucleoporin) | P57740 |
| 580 | VMFNGKVYL | Receptor-interacting factor 1 | Q86XS4 |
| 581 | LEVEVIEAR | Regulating synaptic membrane exocytosis protein 3 (Nim3) (Rab-3 interacting molecule 3) (RIM 3) (RIM3 gamma) | Q9UJD0 |
| 582 | TLLRGIEW | Regulator of G protein signaling protein (Regulator of G-protein signalling like 1) | Q86UV0 |
| 583 | PDFTELDLQ | MHC class II regulatory factor RFX1 (RFX) (Enhancer factor C) (EF-C) | P22670 |
| 584 | DVLFALFSKL | Retinoblastoma-associated protein (PP110) (P105-RB) | P06400 |
| 585 | RSGERKAVQA | Roundabout homolog 3 precursor (Roundabout-like protein 3) | Q96MS0 |
| 586 | GLNEEIARV | Retinoblastoma-associated protein HEC (Kinetochore associated 2) | O14777 |
| 587 | FLFQEPRSI | Retinoblastoma-associated protein RAP140 | Q9UK61 |
| 588 | FLFQEPRSIVT | Retinoblastoma-associated protein RAP140 | Q9UK61 |
| 589 | KEVDILNLP | AT-rich interactive domain-containing protein 4A (ARID domain-containing protein 4A) (Retinoblastoma-binding protein 1) | P29374 |
| 590 | YKLPMEDLK | Jumonji/ARID domain-containing protein 1A (Retinoblastoma-binding protein 2) (RBBP-2) | P29375 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 591 | TMVDRIEEV | Jumonji/ARID domain-containing protein 1A (Retinoblastoma-binding protein 2) (RBBP-2) | P29375 |
| 592 | VEGLLTLSDFDL | RhoGTPase regulating protein variant ARHGAP20-1ad | Q6RJU5 |
| 593 | WMLDKLTGV | 40S ribosomal protein S4, Y isoform 2 | Q8TD47 |
| 594 | LLKHLLLLL | RNA binding motif | Q13380 |
| 595 | ALLSRLEQI | RNA binding protein (Autoantigenic, hnRNP-associated with lethal yellow), long isoform- | Q2M365 |
| 596 | DVYEDELVP | RNA-binding protein | Q8NI52 |
| 597 | VMLGGRNIKV | Ro ribonucleoprotein-binding protein 1 (SIAHBP1 protein) | Q9UHX1 |
| 598 | RLDELGGVYL | HUMAN OTTHUMP00000030902 | Q5JYR6 |
| 599 | FEDKLIEDL | Ryanodine receptor 2 (Cardiac muscle-type ryanodine receptor) (RyR2) (RYR-2) (Cardiac muscle ryanodine receptor-calcium release channel) (hRYR-2) | Q92736 |
| 600 | QLIDKVWQL | SEC14-like protein 1 | Q92503 |
| 601 | FLLEPQMKV | Secreted and transmembrane protein 1 precursor (Protein K12) | Q8WVN6 |
| 602 | ILNEDGSPNL | Neudesin precursor (Neuron-derived neurotrophic factor) | Q9UMX5 |
| 603 | LLAILILAL | P-selectin glycoprotein ligand 1 precursor (PSGL-1) (Selectin P ligand) (CD162 antigen) | Q14242 |
| 604 | SMNRGGYMP | Semaphorin-6D precursor | Q8NFY4 |
| 605 | EFIDGSLQM | Serine/threonine/tyrosine-interacting protein (Protein tyrosine phosphatase-like protein) | Q8WUJ0 |
| 606 | ILVVYVIGL | Olfactory receptor 8G5 (Olfactory receptor OR11-298) | Q8NG78 |
| 607 | TLSERLWLG | Shb-like adapter protein, Shf | Q7M4L6 |
| 608 | VLWDRTFSL | Signal transducer and activator of transcription 1 -alpha/beta (Transcription factor ISGF-3 components p91/p84) STAT1 | P42224 |
| 609 | NVNFFTKPP | Signal transducer and activator of transcription 3 (Acute-phase response factor) | P40763 |
| 610 | ETFSGVYKK | 40S ribosomal protein S7 | P62081 |
| 611 | QLDDLKVEL | 60S ribosomal protein L35 | P42766 |
| 612 | MEDLIHEI | 60S ribosomal protein L7 | P18124 |
| 613 | QTDVDNDLV | Thrombospondin-2 precursor | P35442 |
| 614 | LLIDPPRYI | C3 and PZP-like alpha-2-macroglobulin domain containing 8 | Q8IZJ3 |
| 615 | PSIPTSAQHV | C3 and PZP-like alpha-2-macroglobulin domain containing 8 | Q8IZJ3 |
| 616 | FLDEPTNHL | ATP-binding cassette sub-family F member 2 (Iron-inhibited ABC transporter 2) | Q9UG63 |
| 617 | KMDDPDYWRTV | Ribosome biogenesis protein BOP1 (Block of proliferation 1 protein) | Q14137 |
| 618 | LANVQQVQI | CDNA FLJ13765 fis, clone PLACE4000128, weakly similar, to Mus musculus putative transcription factor mRNA | Q9H8C5 |
| 619 | SLFVVILVT | GD200 cell surface glycoprotein receptor isoform 2 variant 2 | Q6Q8B3 |
| 620 | ARTIKIRNI | LRRC58 protein | Q96CX6 |
| 621 | LVLTSGIVFV | Claudin-6 (Skullin 2) | P56747 |
| 622 | VISFDKLKL | T-box transcription factor TBX18 (T-box protein 18) | O95935 |
| 623 | DLMELYKV | INTS7 protein | Q8WUH5 |
| 624 | LQRRKPTGAF | FRAS1-related extracellular matrix protein 2 precursor (ECM3 homolog) | Q5SZK8 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent SwissProt Identification No. |
|---|---|---|---|
| 625 | KVNNEKFRT | Zinc finger protein 318 (Endocrine regulatory protein) | Q5VUA4 |
| 626 | SLDQPTQTV | Eukaryotic translation initiation factor 3 subunit 8 (eIF3 p110) (eIF3c) | Q99613 |
| 627 | SVTSEGIKAV | HUMAN LOC196394 protein | Q8IY45 |
| 628 | ISLSEPAKPG | Hypothetical protein FLJ44216 | Q8NDZ2 |
| 629 | ILDKKVEKV | Heat shock protein HSP 90-beta (HSP 84) (HSP 90) | P08238 |
| 630 | KLSAEVESLK | Sarcoma antigen NY-SAR-41 (NY-SAR-41) | Q5T9S5 |
| 631 | VTWDAALYI | Protein FAM86A | Q96G04 |
| 632 | YLLPKDIKL | Ras-like family 11 member A (OTTHUMP00000018162) | Q6T310 |
| 633 | RLLEDGEDFNL | Keratin, type I cytoskeletal 18 (Cytokeratin-18) (CK-18) | P05783 |
| 634 | RVLPYPFTH | U3 small nucleolar RNA-associated protein 14 homolog A (Antigen NY-CO-16) | Q9BVJ6 |
| 635 | QNQERLER | Hypothetical protein DKFZp781D1722 | Q68DM0 |
| 636 | QDNIKELEL | Chromosome-associated kinesin KIF4A (Chromokinesin) | O95239 |
| 637 | ILKQRDNEI | Kinesin-like protein KIF6 | Q6ZMV9 |
| 638 | QNELDNVSTL | Myosin-10 (Myosin heavy chain, nonmuscle IIb) (Nonmuscle myosin heavy chain IIb) | P35580 |
| 639 | NIDLLDDGSN | Hypothetical protein C17orf57 | Q8IY85 |
| 640 | VLQSNIQHV | Similar to peptide N-glycanase homolog (S. cerevisiae) | Q9BVR8 |
| 641 | VFFDIAVDGEPL | Peptidyl-prolyl cis-trans isomerase A (EC 5.2.1.8) | P62937 |
| 642 | DFHFPKFSI | Serpin A13 precursor | Q6UXR4 |
| 643 | SYVNLPTIAL | 40S ribosomal protein SA (p40) (34/67 kDa laminin receptor) (Colon carcinoma laminin-binding protein) (NEM/1CHD4) (Multidrug resistance-associated protein MGr1-Ag) | P08865 |
| 644 | SNLEHLGHE | N-acetylglucosamine-1-phosphotransferase subunit gamma precursor | Q9UJJ9 |
| 645 | LKLKLTAVEK | Liprin-beta-1 (Protein tyrosine phosphatase receptor type f polypeptide-interacting protein-binding protein 1) | Q86W92 |
| 646 | GLKGRVFEV | 40S ribosomal protein S3a | P61247 |
| 647 | SLADLQNDEV | 40S ribosomal protein S3a | P61247 |
| 648 | NNLPHLQVV | LOC124512 protein (Fragment) | Q86XA0 |
| 649 | ISFGGSVQL | Hypothetical protein MGC26744 | Q96KX1 |
| 650 | SILDQILQ | Hypothetical protein LOC122258 | Q96KW9 |
| 651 | TLSDLRVYL | Sulfiredoxin-1 (EC 1.8.98.2) | Q9BYN0 |
| 652 | EAFVNSKN | Basalin | Q5QJ38 |
| 653 | VTWDAALYL | Protein FAM86A | Q96G04 |
| 654 | VLDDKLVFV | Transmembrane protein 16F | Q4KMQ2 |
| 655 | YLLDLHSYL | TEB4 protein | O14670 |
| 656 | FLALAVIQL | SLC10A5 | Q5PT55 |
| 657 | TLAEVSTRL | Serine/threonine-protein kinase SNF1-like kinase 1 (EC 2.7.11.1) | P57059 |
| 658 | VIEVYQEQI | LOC391257 protein | Q6P094 |
| 659 | RLWEEAVKA | Zinc finger protein 161 (Putative transcription factor DB1) | Q14119 |
| 660 | SLKTLMLR | Slit homolog 2 protein precursor (Slit-2) | O94813 |
| 661 | EIKKKFKL | FYN-binding protein (FYN-T-binding protein) | O15117 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent SwissProt Identification No. |
|---|---|---|---|
| 662 | VHKEMFIMV | Jumonji/ARID domain-containing protein 1C (SmcX protein) (Xe169 protein) | P41229 |
| 663 | VHKEMFIMV | Jumonji/ARID domain-containing protein 1D (SmcY protein) (Histocompatibility Y antigen) | Q9BY66 |
| 664 | LAGSEVALAGV | Monocarboxylate transporter 3 (MCT 3) | O95907 |
| 665 | IPHDLFTEL | Solute carrier family 4 sodium bicarbonate cotransporter-like member 10- | Q6U841 |
| 666 | FLADPDTVNHLL | Sorting nexin 14, isoform a | Q6NUI7 |
| 667 | RVADRLYGV | Sorting nexin-4 | O95219 |
| 668 | HRPDLLDY | Spectrin beta chain, brain 4 (Spectrin, non-erythroid beta chain 4) | Q9NRC6 |
| 669 | TLDENHPSI | Spermatogenesis-associated protein 7 (Spermatogenesis-associated protein HSD3) | Q9P0W8 |
| 670 | TLAEIAKVEL | Non-POU domain-containing octamer-binding protein (NonO protein) (54 kDa nuclear RNA- and DNA-binding protein) (p54(nrb)) (p54nrb) (55 kDa nuclear protein) | Q15233 |
| 671 | DVAVEAIRL | Cohesin subunit SA-1 (Stromal antigen 1) (SCC3 homolog 1) | Q8WVM7 |
| 672 | LMVDHVTEV | Steroid receptor RNA activator isoform 1 | Q9HD15 |
| 673 | SLYEMVSRV | Structure-specific recognition protein 1 (SSRP1) (Recombination signal sequence recognition protein) (T160) (Chromatin-specific transcription elongation factor 80 kDa subunit) | Q08945 |
| 674 | SINPKRAKL | Suppressor of hairy wing homolog 2 (5'OY11.1) (Zinc finger protein 632) | Q86YH2 |
| 675 | NMYGKVVTV | Transcription elongation factor SPT5 (hSPT5) (DRB sensitivity-inducing factor large subunit) (DSIF large subunit) (DSIF p160) (Tat-cotransactivator 1 protein) (Tat-CT1 protein)- | O00267 |
| 676 | SLFATEQL | Synaptogyrin-3 | O43761 |
| 677 | RLQEGDKILSV | Synaptojanin-2-binding protein (Mitochondrial outer membrane protein 25) | P57105 |
| 678 | AMFDKKVQL | Synemin | Q8TE61 |
| 679 | ALNELLQHV | Talin-1 | Q9Y490 |
| 680 | RVVSMAALAM | TAR RNA loop binding protein (TAR (HIV) RNA binding protein 1) | v |
| 681 | GIIMQIIDV | Taste receptor type 2 member 3 (T2R3) | Q9NYW6 |
| 682 | IFNAIALFL | Taste receptor type 2 member 40 (T2R40) (T2R58) (G-protein coupled receptor 60) | P59535 |
| 683 | LEQGLFSKV | Oxidoreductase HTATIP2 (EC 1.1.1.-) (HIV-1 TAT-interactive protein 2) | Q9BUP3 |
| 684 | KFMHMGKRQK | Transcription initiation factor TFIID subunit 6 (Transcription initiation factor TFIID 70 kDa subunit) (TAF(II)70) (TAFII-70) (TAFII-80) (TAFII80) | P49848 |
| 685 | SNFGNEKL | TRA@ protein | Q6PIP7 |
| 686 | FLLDKKIGV | T-complex protein 1 subunit beta (TCP-1-beta) (CCT-beta) | P78371 |
| 687 | RSLAASNPIL | Telomerase-binding protein EST1A (Ever shorter telomeres 1A) (Telomerase subunit EST1A) (EST1-like protein A) (hSmg5/7a) | Q86U58 |
| 688 | EMESLTGHQ | Tumor endothelial marker 6 (Hypothetical protein TEM6) | Q96PE0 |
| 689 | LDFQEELEV | Ras GTPase-activating-like protein IQGAP2 | Q13576 |
| 690 | SPNSEGDAGDL | Tetratricopeptide repeat protein 15 (TPR repeat protein 15) | Q8WVT3 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent SwissProt Identification No. |
|---|---|---|---|
| 691 | LVYLNESSVLH | Myosin-18A (Myosin XVIIIa) (Myosin containing PDZ domain) (Molecule associated with JAK3 N-terminus) (MAJN) | Q92614 |
| 692 | VAGIKVNQVK | Polycystic kidney and hepatic disease 1 precursor (Fibrocystin) | Q8TCZ9 |
| 693 | ILYELQVEL | TMC4 protein | Q7Z5M3 |
| 694 | EVLDELYRV | MDC-3.13 isoform 1 (TNFAIP8 protein) | Q9UER5 |
| 695 | TNIEDGVFET | Toll-like receptor 8 precursor | Toll-like receptor 8 precursor |
| 696 | EIRKNEGQI | Tolloid-like protein 1 precursor (EC 3.4.24.-) | O43897 |
| 697 | IAAKILSYN | DNA topoisomerase I, mitochondrial precursor (EC 5.99.1.2) (TOP1mt) | Q969P6 |
| 698 | LYGRHFNYL | PAP associated domain-containing protein 5 (EC 2.7.7.-) (Topoisomerase-related function protein 4-2) (TRF4-2) | Q8NDF8 |
| 699 | NLFNKYPAL | Plastin-3 (T-plastin) | P13797 |
| 700 | YLDEIVKEV | Translocated promoter region (To activated MET oncogene) | Q5SWY0 |
| 701 | ENHSSQTDNI | P2Y purinoceptor 13 (P2Y13) (G-protein coupled receptor 86) (G-protein coupled receptor 94) | Q9BPV8 |
| 702 | RTHMLSSL | Transcript Y 5 | Q9BXH6 |
| 703 | QATIAPVTV | Transcription factor Sp4 (SPR-1) | Q02446 |
| 704 | NLFRAPIYL | Transcription initiation factor TFIID subunit 1 (EC 2.7.11.1) (Transcription initiation factor TFIID 250 kDa subunit) (TAF(II)250) (TAFII-250) (TAFII250) (TBP-associated factor 250 kDa) (p250) (Cell cycle gene 1 protein) | P21675 |
| 705 | KLEEEQEKNQL | Transcriptional repressor CTCFL (CCCTC-binding factor) (Brother of the regulator of imprinted sites) (Zinc finger protein CTCF-T) (CTCF paralog | Q8NI51 |
| 706 | LNVDTPFPL | Transducer of regulated CREB protein 3 | Q6UUV7 |
| 707 | ILYELKVEL | Transmembrane channel-like protein 4 | Q7Z404 |
| 708 | KFMHMGKRQK | Transcription initiation factor TFIID subunit 6 (Transcription initiation factor TFIID 70 kDa subunit) (TAF(II)70) (TAFII-70) (TAFII-80) (TAFII80) | P49848 |
| 709 | HSDEGGVASL | Trophinin-associated protein (Tastin) (Trophinin-assisting protein) | Q12815 |
| 710 | AMLTGELKKA | Tryptophanyl-tRNA synthetase (EC 6.1.1.2) (Tryptophan--tRNA ligase) (TrpRS) (IFP53) (hWRS) | P23381 |
| 711 | VFPTHVFPT | Tubulin, gamma complex associated protein 3 | Q5T9Y2 |
| 712 | KELAELRESTS | Tumor necrosis factor ligand superfamily member 6 (Fas antigen ligand) (Fas ligand) (CD178 antigen) (CD95L protein) (Apoptosis antigen ligand) (APTL) [Contains: Tumor necrosis factor ligand superfamily member 6, membrane form | P48023 |
| 713 | LTDKEGWIL | Tumor necrosis factor, alpha-induced protein 1, endothelial (B12 protein) | Q13829 |
| 714 | VVTYKNENI | Netrin receptor DCC precursor (Tumor suppressor protein DCC) (Colorectal cancer suppressor) | P43146 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent Swiss-Prot Identification No. |
|---|---|---|---|
| 715 | TVAEGLIED | Adipocyte-derived leucine aminopeptidase precursor (EC 3.4.11.-) (A-LAP) (ARTS-1) (Aminopeptidase PILS) (Puromycin-insensitive leucyl-specific aminopeptidase) (PILS-AP) (Type 1 tumor necrosis factor receptor shedding aminopeptidase | Q9NZ08 |
| 716 | NEKIKKDEL | U1 small nuclear ribonucleoprotein A (U1 snRNP protein A) (U1A protein) (U1-A | P09012 |
| 717 | ILDESHERV | U6 snRNA-associated Sm-like protein LSm8 | O95777 |
| 718 | NLYSDYILN | Ubiquitin-protein ligase E3A (EC 6.3.2.-) (E6AP ubiquitin-protein ligase) (Oncogenic protein-associated protein E6-AP) (Human papillomavirus E6-associated protein) | Q05086 |
| 719 | RYVNGHAK | Ubiquitin carboxyl-terminal hydrolase 3 (EC 3.1.2.15) (Ubiquitin thioesterase 3) (Ubiquitin-specific-processing protease 3) (Deubiquitinating enzyme 3) | Q9Y6I4 |
| 720 | KLLDLELAPS | UBX domain-containing protein 2 | Q92575 |
| 721 | YLYDLNHTL | UNC93 homolog B1 (UNC-93B protein) (hUNC93B1) | Q9H1C4 |
| 722 | FFFWLMEL | Splice isoform 5 of Q9H171 | Q9H171-5 |
| 723 | ELSSLKETHI | CDNA FLJ46282 fis, clone TESTI4031066 | Q6ZRK6 |
| 724 | KLGSVPVTV | CCDC73 protein | Q6P5Q7 |
| 725 | ALWERIEGV | Caspase recruitment domain-containing protein 10 (CARD-containing MAGUK protein 3) (Carma 3) | Q9BWT7 |
| 726 | VKAQEILR | Caspase recruitment domain-containing protein 10 (CARD-containing MAGUK protein 3) (Carma 3) | Q9BWT7 |
| 727 | ANVDAIVVSV | Chromatin-specific transcription elongation factor FACT 140 kDa subunit | Q9Y5B9 |
| 728 | CKDGEDSIIR | Beta-defensin 120 precursor | Q8N689 |
| 729 | DNTKKSDKT | Alpha-catulin (Catenin alpha-like protein 1) (Alpha-catenin-related protein) | Q9UBT7 |
| 730 | EFLGDSIMQ | Ribonuclease III (EC 3.1.26.3) (RNase III) | Q9NRR4 |
| 731 | EFLQEGLEK | Seizure related 6 homolog | Q53EL9 |
| 732 | FLLKCLEQV | Granulocyte colony-stimulating factor precursor (G-CSF) (Pluripoietin) (Filgrastim) (Lenograstim) | P09919 |
| 733 | FLTDSNNIKEV | Lysyl-tRNA synthetase | Q9HB23 |
| 734 | GGVQELLNQQ | Protein C6orf130 | Q9Y530 |
| 735 | GKPRRKSNL | Melanophilin (Exophilin-3) (Synaptotagmin-like protein 2a) (Slp homolog lacking C2 domains a) | Q9BV36 |
| 736 | HIKEELMHG | Novel protein (Possible ortholog of mouse phosphoinositide-3-kinase adaptor protein 1 (Pik3ap1) | Q5VTR6 |
| 737 | HIPFFLHN | AER61 glycosyltransferase | Q6P985 |
| 738 | ILEKKVEKV | Heat shock protein HSP 90-alpha (HSP 86) | P07900 |
| 739 | ILMEHIHKL | 60S ribosomal protein L19 | P84098 |
| 740 | KASQLGIFISKV | PDZ domain-containing protein 11 | Q5EBL8 |
| 741 | KILEVMHTK | Dedicator of cytokinesis 11-; Cdc42-associated guanine nucleotide exchange factor ACG/DOCK11 | Q5JSL3 |
| 742 | LAVGTSPVLA | Hypothetical protein FLJ26930 | Q6ZNX6 |
| 743 | LLAEEARKL | Laminin gamma-1 chain precursor (Laminin B2 chain) | P11047 |
| 744 | LLGICFCIA | ATP-binding cassette transporter sub-family C member 11 (Multidrug resistance-associated protein 8) | Q96J66 |
| 745 | LMAEMGVHSV | Uridine/cytidine kinase-like 1 | Q9NWZ5 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent SwissProt Identification No. |
|---|---|---|---|
| 746 | ISRLENITV | Butyrophilin-like protein 8 precursor | Q6UX41 |
| 747 | MISLPGPLVTN | Endothelial cell-selective adhesion molecule precursor | Q96AP7 |
| 748 | MLLDVMHTV | Poly(A)-specific ribonuclease PARN (EC 3.1.13.4) (Polyadenylate-specific ribonuclease) (Deadenylating nuclease) (Deadenylation nuclease) | O95453 |
| 749 | NVMNLIDFV | Voltage-gated potassium channel KCNA7 | Q96RP8 |
| 750 | NVTMKDNKI | F-box protein 11 | Q52ZP1 |
| 751 | PRSNIDVNI | rythrocyte membrane protein band 4.1 like 5 | Q7Z5S1 |
| 752 | PSAQPLLSL | CDNA FLJ45015 fis, clone BRAWH3014639 | Q6ZT30 |
| 753 | QLKESKLKI | FAM13A1_v2 protein | Q24JP0 |
| 754 | RDAPHLPDG | Hypothetical protein FLJ26432 | Q6ZP70 |
| 755 | RLPPEGILHNV | VPS13D-1A protein | Q709C5 |
| 756 | SEGAEYDDQT | Coagulation factor VIII precursor (Procoagulant component) (Antihemophilic factor) (AHF) | P00451 |
| 757 | SLFERLVKV | NFX1-type zinc finger-containing protein 1 | Q9P2E3 |
| 758 | SLLDKIIGA | Polymerase I and transcript release factor (PTRF protein) | Q6NZI2 |
| 759 | SMMDVDHQI | T-complex protein 1 subunit epsilon (TCP-1-epsilon) (CCT-epsilon) | P48643 |
| 760 | TLDEKIEKV | Probable ATP-dependent RNA helicase DDX27 (EC 3.6.1.-) (DEAD box protein 27) | Q96GQ7 |
| 761 | TLLEDGTFKV | HSCARG | Q9HBL8 |
| 762 | TVLKTKFSS | CDNA FLJ43956 fis, clone TESTI4015681 | Q6ZU72 |
| 763 | VIFEDVGRQVL | Mitochondrial-processing peptidase alpha subunit, mitochondrial precursor (EC 3.4.24.64) (Alpha-MPP) | Q10713 |
| 764 | YILDINPLL | CDNA FLJ45287 fis, clone BRHIP3002124 | Q6ZSR0 |
| 765 | YKTFSTSMMLL | Hypothetical protein C12orf62 | Q96I36 |
| 766 | RLPPEGILHNV | VPS13D-2A protein | Q709C4 |
| 767 | LLGPRVLSP | CDNA FLJ32009 fis, clone NT2RP7009498, weakly similar to FIBULIN-1, ISOFORM A | Q96DN2 |
| 768 | FIILLVTYI | Transient receptor potential cation channel subfamily V member 4 (TrpV4) (osm-9-like TRP channel 4) (OTRPC4) (Vanilloid receptor-like channel 2) (Vanilloid receptor-like protein 2) (VRL-2) | Q9HBA0 |
| 769 | FYDIEILK | Vascular endothelial growth factor D precursor (VEGF-D) (c-fos-induced growth factor) (FIGF) | O43915 |
| 770 | WMAPESIFDKI | Vascular endothelial growth factor receptor 1 precursor (EC 2.7.10.1) (VEGFR-1) (Vascular permeability factor receptor) (Tyrosine-protein kinase receptor FLT) (Flt-1) (Tyrosine-protein kinase FRT) (Fms-like tyrosine kinase 1) | P17948 |
| 771 | LLDQQNPDE | Proto-oncogene C-crk (P38) (Adapter molecule crk) | P46108 |
| 772 | VMFKKIKSFEV | VDUP1 protein (Thioredoxin interacting protein) | Q9H3M7 |
| 773 | KLLEGEESRISL | Vimentin | P08670 |
| 774 | KLLEGEESRISL | HUMAN CTCL tumor antigen HD-CL-06 (Vimentin variant) | Q548L2 |
| 775 | RILGAVAKV | Vinculin (Metavinculin) | P18206 |
| 776 | SLSMVNHRL | Integrin alpha-3 precursor (Galactoprotein B3) (GAPB3) (VLA-3 alpha chain) (FRP-2) (CD49c antigen) [Contains: Integrin alpha-3 heavy chain; Integrin alpha-3 light chain] | P26006 |

TABLE 2-continued

Description of Fragments, Parent Sequence Identification and Parent SwissProt Identification Number for peptides 1-791 and 1514-1533

| SEQ ID NO: | Fragment | Parent Sequence Identification | Parent SwissProt Identification No. |
|---|---|---|---|
| 777 | VGQADGGLSVLR | Voltage-dependent T-type calcium channel alpha-1H subunit (Voltage-gated calcium channel alpha subunit Cav3.2) (Low-voltage-activated calcium channel alpha1 3.2 subunit) | O95180 |
| 778 | DVATILSRR | Wiskott-Aldrich syndrome protein family member 4 (WASP-family protein member 4) | Q8IV90 |
| 779 | PKFEVIEKPQA | ATP synthase coupling factor 6, mitochondrial precursor (EC 3.6.3.14) (ATPase subunit F6) | P18859 |
| 780 | NCTTIDDSLAI | Proto-oncogene protein Wnt-3 precursor | P56703 |
| 781 | ILPIVILAN | myloid beta A4 precursor protein-binding family A member 2 (Neuron-specific X11L protein) (Neuronal Munc 18-1-interacting protein 2) (Mint-2) (Adapter protein X11 beta) | Q99767 |
| 782 | EFLELSAAQE | Zinc finger CCHC domain-containing protein 5 | Q8N8U3 |
| 783 | SLTDKVQEA | Myeloidl/ymphoid or mixed-lineage leukemia (Trithorax homolog, Drosophila) variant | Q59FF2 |
| 784 | SKNSALEYQL | Zinc finger protein DZIP1 (DAZ-interacting protein 1/2) | Q86YF9 |
| 785 | LQDVEEVEI | Hypothetical protein DKFZp761O1618 | Q69YS5 |
| 786 | FLDEPTNHL | ATP-binding cassette sub-family F member 2 (Iron-inhibited ABC transporter 2) | Q9UG63 |
| 787 | KMDDPDYWRTV | Ribosome biogenesis protein BOP1 (Block of proliferation 1 protein) | Q14137 |
| 788 | LANVQQVQI | CDNA FLJ13765 fis, clone PLACE4000128 | Q9H8C5 |
| 789 | KLDPTKTTL | NDRG1 protein (N-myc downstream regulated gene 1 protein) | Q92597 |
| 790 | HLTYLNVYL | Pre-mRNA splicing factor ATP-dependent RNA helicase PRP16 | Q92620 |
| 791 | ALWDKLFNL | Nesprin 2 (Nuclear envelope spectrin repeat protein 2) | Q9NU50 |
| 1514 | KIMDQVQQA | Adenomatous polyposis coli | P25054 |
| 1515 | RLQEDPPAGV | Ubiquitin conjugating enzyme E2 | P49459 |
| 1516 | KLDVGNAEV | B cell receptor-associated protein BAP31 (CDM protein) 6c6-AG | P5572 |
| 1517 | FLYDDNQRV | Topoisomerase Il-alpha | P11388 |
| 1518 | FLYDDNQRV | Topoisomerase II beta | Q02880 |
| 1519 | ALMEQQHYV | Integrin beta8 subunit precursor | P26012 |
| 1520 | YLMDTSGKV | Replication Protein A | P27694 |
| 1521 | ILDDIGHGV | Abl Binding protein 3 | U31089 |
| 1522 | LLDRFLATV | Cyclin I | Q14094 |
| 1523 | LLIDDKGTIKL | Cell Division Control Protein 2 (CDC2) | P06493 |
| 1524 | RLYPWGVVEV | Septin 2 (NEDD5) | Q15019 |
| 1525 | KLQELNYNL | STAT1 alpha/beta | P42224 |
| 1526 | ILIEHLYGL | LDL Receptor-related protein (LRP) | Q07954 |
| 1527 | YLIELIDRV | TACE (ADAM17) | NP-068604 |
| 1528 | NLMEQPIKV | Junction plakoglobin (gamma catenin) | P14923 |
| 1529 | FLAEDALNTV | EDDR1 | Q08345 |
| 1530 | TLLNVIKSV | IP3 receptor type II | Q14571 |
| 1531 | MLKDIIKEY | Melanoma-associated antigen D2 (MAGE-D2 antigen) (MAGE-D) (Breast cancer-associated gene 1 protein) (BCG-1) (11B6) (Hepatocellular carcinoma-associated protein JCL-1) | Q9UNF1 |
| 1532 | TSYVKVLEH | Melanoma-associated antigen 4 (MAGE-4 antigen) (MAGE-X2) (MAGE-41) | P43358 |
| 1533 | HEYLKAFKV | HUMAN Retinoblastoma-like protein 2 (130 kDa retinoblastoma-associated protein) (PRB2) (P130) (RBR-2) | Q08999 |

TABLE 3

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 792 | BCL-6 corepressor long isoform_ | Q6W2J9 |
| 793 | E1B_19K/Bcl-2-interacting protein Nip3 | Q12983 |
| 794 | Similar to Heat shock protein HSP 90-beta (HSP 84) (HSP 90) | P08238 |
| 795 | Cytochrome P450 11B2, mitochondrial precursor | P19099 |
| 796 | 2'-5'oligoadenylate synthetase 3 | Q2HJ14 |
| 797 | 26S protease regulatory subunit 4 (P26s4) | P62191 |
| 798 | 26S proteasome non-ATPase regulatory subunit 7 | P51665 |
| 799 | 26S proteasome non-ATPase regulatory subunit 14 | O00487 |
| 800 | 40S ribosomal protein S16 | P62249 |
| 801 | 40S ribosomal protein S6 (Phosphoprotein NP33) | P62753 |
| 802 | 40S ribosomal protein S9 | P46781 |
| 803 | 60S ribosomal protein L10a (CSA-19) | P62906 |
| 804 | 6-phosphofructo-2-kinase/fructose-2,6-biphosphatase 4 (6PF-2-K/Fru-2,6-P2ASE testis-type isozyme) | Q16877 |
| 805 | Cleavage and polyadenylation specificity factor, 73 kDa subunit (CPSF 73 kDa subunit) | Q9UKF6 |
| 806 | A kinase anchor protein 10, mitochondrial precursor | O43572 |
| 807 | Actin, cytoplasmic 1 (Beta-actin) | P60709 |
| 808 | Activated T-cell marker CD109 | Q6YHK3 |
| 809 | Activin receptor type 2A precursor (EC 2.7.11.30) | P27037 |
| 810 | ADAM19 protein | Q8TBU7 |
| 811 | AP-1 complex subunit beta-1 (Adapter-related protein complex 1 beta-1 subunit) (Beta-adaptin 1) | Q10567 |
| 812 | Adaptor-related protein NF01019537 | Q9BYI8 |
| 813 | Lung alpha/beta hydrolase protein 1 | Q96SE0 |
| 814 | Alpha-actinin-3 | Q08043 |
| 815 | Ankyrin-2 (Brain ankyrin) (Ankyrin-B) | Q01484 |
| 816 | Ankyrin repeat and SOCS box protein 17 | Q8WXJ9 |
| 817 | Anti-colorectal carcinoma heavy chain | Q65ZQ1 |
| 818 | APOBEC1 complementation factor (APOBEC1-stimulating protein) | Q9NQ94 |
| 819 | Probable DNA dC->dU-editing enzyme APOBEC-3D (EC 3.5.4.—) | Q96AK3 |
| 820 | Apolipoprotein-L4 precursor (Apolipoprotein L-IV) | Q9BPW4 |
| 821 | Apoptosis stimulating of p53 protein 1 | Q96KQ4 |
| 822 | Nucleoporin 188 kDa (arachin) | Q5SRE5 |
| 823 | Protein ariadne-1 homolog (ARI-1) (Ubiquitin-conjugating enzyme E2-binding protein 1) | Q9Y4X5 |
| 824 | Set1/Ash2 histone methyltransferase complex subunit ASH2 (ASH2-like protein) | Q9UBL3 |
| 825 | ATP synthase F0 subunit 8 | Q85KZ3 |
| 826 | Splice isoform 2 of Q9H7F0 ATPase_family_homolog_up-regulated_in_senescence_cells_ | Q9H7F0 |
| 827 | Probable phospholipid-transporting ATPase IA (EC 3.6.3.1) (Chromaffin granule ATPase II) | Q9Y2Q0 |
| 828 | ATP-binding cassette A10 | Q8WWZ4 |
| 829 | ATP-binding cassette sub-family A member 2 (ATP-binding cassette transporter 2) (ATP-binding cassette 2) | Q9BZC7 |
| 830 | Autoantigen RCD8 | Q6P2E9 |
| 831 | xonemal dynein heavy chain 8 | Q96JB1 |
| 832 | Butyrophilin-like protein 8 precursor | Q6UX41 |
| 833 | Ubiquitin carboxyl-terminal hydrolase 20 (EC 3.1.2.15) | Q9Y2K6 |
| 834 | Bardet-Biedl syndrome 7 protein (BBS2-like protein 1) | Q8IWZ6 |
| 835 | Large proline-rich protein BAT2 (HLA-B-associated transcript 2) | P48634 |
| 836 | Bcl-2 related ovarian killer | Q9UL32 |
| 837 | Lipopolysaccharide-responsive and beige-like anchor protein (CDC4-like protein) | P50851 |
| 838 | Splice isoform 3 of P35612 | P35612-3 |
| 839 | UDP-GlcNAc:betaGal beta-1,3-N-acetylglucosaminyltransferase 3 (EC 2.4.1.—) | Q9Y2A9 |
| 840 | Cell growth inhibiting protein 39 | Q2TTR2 |
| 841 | BH3-interacting domain death agonist (BID) | P55957 |
| 842 | CD48 antigen precursor (B-lymphocyte activation marker BLAST-1) | P09326 |
| 843 | Bone morphogenetic protein receptor type-2 precursor (EC 2.7.11.30) | Q13873 |
| 844 | Bullous pemphigoid antigen 1, isoform 7 | Q8WXK8 |
| 845 | BRCA1 associated RING domain 1 variant | Q53F80 |
| 846 | Breast cancer type 2 susceptibility protein (Fanconi anemia group D1 protein) | P51587 |

TABLE 3-continued

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 847 | Protein BRE (Brain and reproductive organ-expressed protein) (BRCA1/BRCA2-containing complex subunit 45) | Q9NXR7 |
| 848 | Breast cancer 1 early onset | Q3LRJ0 |
| 849 | Breast and ovarian cancer susceptibility protein | Q7KYU6 |
| 850 | BTG2 protein (NGF-inducible anti-proliferative protein PC3) | P78543 |
| 851 | Nuclear protein 5qNCA | Q7LBC6 |
| 852 | CAD protein [Includes: Glutamine-dependent carbamoyl-phosphate synthase (EC 6.3.5.5); Aspartate carbamoyltransferase (EC 2.1.3.2); Dihydroorotase (EC 3.5.2.3)] | P27708 |
| 853 | Cadherin EGF LAG seven-pass G-type receptor 3 precursor (Flamingo homolog 1) (hFmi1) (Multiple epidermal growth factor-like domains 2) (Epidermal growth factor-like 1) | Q9NYQ7 |
| 854 | Cadherin FIB3 | Q6UW70 |
| 855 | Integrin alpha-3 precursor (Galactoprotein B3) | P26006 |
| 856 | Calcineurin B homologous protein 2 (Hepatocellular carcinoma-associated antigen 520) | O43745 |
| 857 | Calcium/calmodulin-dependent protein kinase II inhibitor alpha (CaMKIINalpha) | Q7Z7J9 |
| 858 | Calpain-11 (EC 3.4.22.—) | Q9UMQ6 |
| 859 | Alpha-1 catenin (Cadherin-associated protein) (Alpha E-catenin) | P35221 |
| 860 | Neural cell adhesion molecule variant | Q59FY0 |
| 861 | Ribosomal L1 domain-containing protein 1 (Cellular senescence-inhibited gene protein) | O76021 |
| 862 | CENP-F kinetochore protein (Centromere protein F) (Mitosin) | P49454 |
| 863 | Centaurin-delta 1 (Cnt-d1) (Arf-GAP, Rho-GAP, ankyrin repeat and pleckstrin homology domain-containing protein 2) | Q8WZ64 |
| 864 | Centrosomal protein 2 (Centrosomal Nek2-associated protein 1) (C-NAP1) | Q9BV73 |
| 865 | Pericentriol material 1 | Q15154 |
| 866 | Cervical cancer suppressor gene 5 | Q8NFX8 |
| 867 | T-complex protein 1 subunit zeta-2 | Q92526 |
| 868 | Chemokine-like factor (C32) | Q9UBR5 |
| 869 | Vacuolar protein sorting 13A | Q96RL7 |
| 870 | Chromodomain-helicase-DNA-binding protein 2 (EC 3.6.1.—) | O14647 |
| 871 | FERM domain-containing protein 6 | Q96NE9 |
| 872 | Putative protein C21orf56 | Q9H0A9 |
| 873 | Adiponutrin (iPLA2-epsilon) | Q9NST1 |
| 884 | Coatomer subunit gamma-2 | Q9UBF2 |
| 875 | Sodium/potassium/calcium exchanger 2 precursor | Q9UI40 |
| 876 | Exportin-1 (Chromosome region maintenance 1 protein homolog) | O14980 |
| 877 | CUB and sushi domain-containing protein 3 precursor | Q7Z407 |
| 878 | Cullin-7 (CUL-7) | Q14999 |
| 879 | Cyclic AMP-dependent transcription factor ATF-4 | P18848 |
| 880 | S-phase kinase-associated protein 1A (Cyclin A/CDK2-associated protein p19) | P63208 |
| 881 | Cyclin-A1 | P78396 |
| 882 | Cyclin M3, isoform 1 | Q8NE01 |
| 883 | Cystathionine beta-synthase human homolog of Cynomolgus monkey gene product | Q58H57 |
| 884 | Cytochrome P450 2E1 (EC 1.14.14.1) | P05181 |
| 885 | Keratin, type II cytoskeletal 8 | P05787 |
| 886 | CPEB2 protein | Q3B8N6 |
| 887 | Probable ATP-dependent RNA helicase DDX5 (EC 3.6.1.—) | P17844 |
| 888 | Dedicator of cytokinesis protein 1 | Q14185 |
| 889 | Development and differentiation-enhancing factor 2 | O43150 |
| 890 | Probable ubiquitin carboxyl-terminal hydrolase FAF-Y (EC 3.1.2.15) | O00507 |
| 891 | G2 and S phase expressed protein 1 | Q9NYZ3 |
| 892 | HUMAN CDNA FLJ30829 fis, clone FEBRA2001790, highly similar to *Xenopus laevis* RRM-containing protein SEB-4 mRNA | Q96NI3 |
| 893 | KIAA1799 protein | Q96B95 |

TABLE 3-continued

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 894 | Peroxisomal proliferator-activated receptor A-interacting complex 285 kDa protein (EC 3.6.1.—) (ATP-dependent helicase PRIC285) | Q9BYK8 |
| 895 | HUMAN KIAA1922 | Q96PW6 |
| 896 | Transcription elongation factor SPT5 (DLC-1)(deleted in liver cancer-1) | O00267 |
| 897 | DNA damage-binding protein 1 (Damage-specific DNA-binding protein 1) | Q16531 |
| 898 | DNA excision repair protein ERCC-6 | Q03468 |
| 899 | DNA polymerase alpha subunit B (DNA polymerase alpha 70 kDa subunit) | Q14181 |
| 900 | DNA replication licensing factor MCM2 (Minichromosome maintenance protein 2 homolog) | P49736 |
| 901 | DNA2-like homolog (EC 3.6.1.—) (DNA replication ATP-dependent helicase-like homolog) | P51530 |
| 902 | Estrogen response element binding protein (cotton-top Tarmarin), DNA2-like homolog (human) | O77798 |
| 903 | DNA damage-inducible transcript 3 (DDIT-3) (Growth arrest and DNA-damage-inducible protein GADD153) | P35638 |
| 904 | DNA-directed RNA polymerase I largest subunit (EC 2.7.7.6) | O95602 |
| 905 | DnaJ homolog subfamily C member 1 | Q96KC8 |
| 906 | Splice isoform 2 of P35462 | P35462-2 |
| 907 | RuvB-like 2 (EC 3.6.1.—) (48-kDa TATA box-binding protein-interacting protein) | Q9Y230 |
| 908 | DRE1_protein | Q9NXT9 |
| 909 | Dynactin-1 (150 kDa dynein-associated polypeptide) | Q14203 |
| 910 | Dynein heavy chain, cytosolic (DYHC) | Q14204 |
| 911 | Echinoderm microtubule associated protein-like 5 | Q6UYC9 |
| 912 | ECT2 protein (Epithelial cell-transforming sequence 2 oncogene) | Q9H8V3 |
| 913 | Endothelial differentiation-related factor 1 (EDF-1) | O60869 |
| 914 | Developmentally-regulated endothelial cell locus 1 protein) | O43854 |
| 915 | Elongation factor 2 (EF-2) | P13639 |
| 916 | J domain protein C21orf55 | Q9NX36 |
| 917 | EMILIN-3 precursor (EMILIN-5) (Elastin microfibril interface-located protein 5) | Q9NT22 |
| 918 | Synaptotagmin-like protein 4 (Exophilin-2) | Q96C24 |
| 919 | Enhancer of filamentation 1 (HEF1) | Q14511 |
| 920 | Band 4.1-like protein 3 (4.1B) (Differentially expressed in adenocarcinoma of the lung protein 1) (DAL-1) | Q9Y2J2 |
| 921 | Epidermal growth factor receptor substrate 15 | P42566 |
| 922 | Epithelial membrane protein 3 (EMP-3) (YMP protein) | P54852 |
| 923 | Zyxin (Zyxin-2) | Q15942 |
| 924 | Eukaryotic translation initiation factor 4 gamma 1 | Q04637 |
| 925 | F-actin capping protein beta subunit | P47756 |
| 926 | Protocadherin Fat 2 precursor (hFat2) (Multiple epidermal growth factor-like domains 1) | Q9NYQ8 |
| 927 | KIAA1752 protein | Q9C0B1 |
| 928 | Fc alpha/mu receptor | Q8WWV6 |
| 929 | Low affinity immunoglobulin gamma Fc region receptor III-A precursor (IgG Fc receptor III-2) | P08637 |
| 930 | FYVE, RhoGEF and PH domain-containing protein 2 (Zinc finger FYVE domain-containing protein 4) | Q7Z6J4 |
| 931 | Fibroblast growth factor receptor-like 1 precursor (FGF receptor-like protein 1) | Q8N441 |
| 932 | Fibroblast growth factor receptor 4 precursor (EC 2.7.10.1) | P22455 |
| 933 | Fibroblast growth factor receptor 2 precursor (EC 2.7.10.1) (FGFR-2) | P21802 |
| 934 | FK506-binding protein 7 precursor (EC 5.2.1.8) | Q9Y680 |
| 935 | Glomulin (FKBP-associated protein) (FK506-binding protein-associated protein) | Q92990 |
| 936 | FKSG73 | Q9BWW1 |
| 937 | Flavin containing monooxygenase 3 isoform 2 variant | Q53FW5 |
| 938 | Protein flightless-1 homolog | Q13045 |
| 939 | Guanylate-binding protein 4 | Q96PP9 |
| 940 | Filamin-A (Alpha-filamin) (Filamin-1) (Endothelial actin-binding protein) | P21333 |
| 941 | FLJ10101 protein | Q8WU94 |
| 942 | CDNA FLJ14503 fis, clone NT2RM1000252, weakly similar to H. sapiens E-MAP-115 mRNA | Q96T17 |
| 943 | E2F8 protein | Q5BKY4 |

TABLE 3-continued

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 944 | Human Hypothetical protein | Q2VPJ3 |
| 945 | HUMAN CDNA FLJ34154 fis, clone FCBBF3013058 | Q8NB70 |
| 946 | Hypothetical protein FLJ43654 (Hypothetical protein C3orf62) | Q6ZUJ4 |
| 947 | HUMAN CDNA FLJ46180 fis, clone TESTI4004031 | Q6ZRQ5 |
| 948 | Flotillin-2 (Epidermal surface antigen) (ESA) | Q14254 |
| 949 | Serine/threonine-protein kinase ATR (EC 2.7.11.1) (Ataxia telangiectasia and Rad3-related protein) (FRAP-related protein 1) | Q13535 |
| 950 | Frizzled 5 precursor (Frizzled-5) | Q13467 |
| 951 | Fructose-bisphosphate aldolase C (EC 4.1.2.13) | P09972 |
| 952 | G protein pathway suppressor 1 isoform 1 variant | Q53HS2 |
| 953 | KiSS-1 receptor (KiSS-1R) (Kisspeptins receptor) (Metastin receptor) (G-protein coupled receptor 54) | Q969F8 |
| 954 | Probable G-protein coupled receptor 55 | Q9Y2T6 |
| 955 | Probable G-protein coupled receptor 35 | Q9HC97 |
| 956 | G-protein coupled receptor family C group 5 member C precursor (Retinoic acid-induced gene 3 protein) | Q9NQ84 |
| 957 | Leucine-rich repeat-containing G-protein coupled receptor 5 precursor (Orphan G-protein coupled receptor HG38) (G-protein coupled receptor 49) (G-protein coupled receptor 67) | O75473 |
| 958 | Probable G-protein coupled receptor 133 precursor (G-protein coupled receptor PGR25) | Q6QNK2 |
| 959 | G1 to S phase transition protein 1 homolog (GTP-binding protein GST1-HS) | P15170 |
| 960 | Gamma-aminobutyric-acid receptor alpha-6 subunit precursor (GABA(A) receptor) | Q16445 |
| 961 | Ganglioside-induced differentiation-associated protein 1-like 1 (GDAP1-L1) | Q96MZ0 |
| 962 | Gap junction alpha-5 protein (Connexin-40) (Cx40) | P36382 |
| 963 | GEM-interacting protein (GMIP) | Q9P107 |
| 964 | Golgin subfamily B member 1 (Giantin) | Q14789 |
| 965 | UDP-N-acetylhexosamine pyrophosphorylase (Antigen X) | Q16222 |
| 966 | Neutral alpha-glucosidase AB precursor (EC 3.2.1.84) | Q14697 |
| 967 | Probable dolichyl pyrophosphate Glc1Man9GlcNAc2 alpha-1,3-glucosyltransferase (EC 2.4.1.—) | Q9BVK2 |
| 968 | Bifunctional aminoacyl-tRNA synthetase [Includes: Glutamyl-tRNA synthetase (EC 6.1.1.17) (Glutamate--tRNA ligase); Prolyl-tRNA synthetase (EC 6.1.1.15) (Proline--tRNA ligase)] | P07814 |
| 969 | Glycoprotein nmb-like protein | Q8IXJ5 |
| 970 | Prolactin-releasing peptide receptor (PrRP receptor) (PrRPR) (G-protein coupled receptor 10) | P49683 |
| 971 | G protein-coupled receptor 112 | Q5EGP2 |
| 972 | Growth factor receptor-bound protein 14 (GRB14 adapter protein) | Q14449 |
| 973 | GRIP and coiled-coil domain-containing protein 2 (Golgi coiled coil protein GCC185) (CTCL tumor antigen se1-1) | Q8IWJ2 |
| 974 | GROS1-L protein | Q9HC86 |
| 975 | Growth hormone secretagogue receptor type 1 (GHS-R) | Q92847 |
| 976 | Glutathione S-transferase A4-4 (EC 2.5.1.18) | O15217 |
| 977 | GTP-binding protein Rhes (Ras homolog enriched in striatum) (Tumor endothelial marker 2) | Q96D21 |
| 978 | GTP-binding protein Rit1 (Ras-like protein expressed in many tissues) | Q92963 |
| 979 | VGFG2573 | Q6UY45 |
| 980 | Hypothetical protein HDLBP | Q53QU2 |
| 981 | Heat shock protein 75 kDa, mitochondrial precursor (HSP 75) (Tumor necrosis factor type 1 receptor-associated protein) | Q12931 |
| 982 | Heat shock protein apg-1 | Q53ZP9 |
| 983 | Tumor rejection antigen (Gp96) 1 | Q5CAQ5 |
| 984 | Heat-shock protein beta-3 (HspB3) (Heat shock 17 kDa protein) | Q12988 |
| 985 | Low-density lipoprotein receptor-related protein 5 precursor | O75197 |
| 986 | Regulator of telomere elongation helicase 1 (EC 3.6.1.—) (Helicase-like protein NHL) | Q9NZ71 |
| 987 | Hematopoietic protein 1 | Q52LW0 |
| 988 | Heme oxygenase 1 (EC 1.14.99.3) (HO-1) | P09601 |

TABLE 3-continued

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 989 | Heparan sulfate glucosamine 3-O-sulfotransferase 5 (EC 2.8.2.23) | Q8IZT8 |
| 990 | Hepatocellular carcinoma-associated antigen 66 | Q9NYH9 |
| 991 | Melanoma-associated antigen E2 (MAGE-E2 antigen) (Hepatocellular carcinoma-associated protein 3) | Q8TD90 |
| 992 | 26S proteasome non-ATPase regulatory subunit 10 (26S proteasome regulatory subunit p28) Hepatocellular carcinoma-associated protein p28-II | O75832 |
| 993 | Hephaestin | Q5JUU1 |
| 994 | HECT domain and RCC1-like domain-containing protein 2 (HERC2) | O95714 |
| 995 | Heterogeneous nuclear ribonucleoproteins A2/B1 (hnRNP A2/hnRNP B1) | P22626 |
| 996 | Heterogeneous nuclear ribonucleoprotein R (hnRNP R) | O43390 |
| 997 | HEXIM1 protein (HMBA-inducible) | O94992 |
| 998 | Histatin-1 precursor (Histidine-rich protein 1) | P15515 |
| 999 | Histone deacetylase 1 (HD1) | Q13547 |
| 1000 | Histone deacetylase 9 (HD9) (HD7B) (HD7) | Q9UKV0 |
| 1001 | Homeodomain-interacting protein kinase 2 (EC 2.7.11.1) | Q9H2X6 |
| 1002 | Cullin-2 (CUL-2) | Q13617 |
| 1003 | SWI/SNF-related matrix-associated actin-dependent regulator of chromatin subfamily A member 5 (EC 3.6.1.—) | O60264 |
| 1004 | HUMAN HSPC027 26S proteasome non-ATPase regulatory subunit 13 Synonyms 26S proteasome regulatory subunit S11 26S proteasome regulatory subunit p40.5 | Q9Y6E3 |
| 1005 | Hypothetical protein (Novel protein HSPC117) (DJ149A16.6 protein) (Hypothetical protein HSPC117) | Q9Y3I0 |
| 1006 | Claudin domain-containing protein 1 (Membrane protein GENX-3745) Q9NY35 | Q9NY35 |
| 1007 | Large neutral amino acids transporter small subunit 2 (L-type amino acid transporter 2) (hLAT2) | Q9UHI5 |
| 1008 | Heterogeneous nuclear ribonucleoprotein C-like 1 (hnRNP core protein C-like 1) | O60812 |
| 1009 | Ornithine decarboxylase (EC 4.1.1.17) (ODC) | P11926 |
| 1010 | Regulator of nonsense transcripts 2 (Nonsense mRNA reducing factor 2) (Up-frameshift suppressor 2 homolog) (hUpf2) | Q9HAU5 |
| 1011 | ATX10_HUMAN Ataxin-10 | Q9UBB4 |
| 1012 | KIAA1833 protein | Q569G6 |
| 1013 | HUMAN UDP-GalNAc:betaGlcNAc beta 1,3-galactosaminyltransferase, polypeptide 2 (Beta 1,3-N-acetylgalactosaminyltransferase-II) (MGC39558) | Q8NCR0 |
| 1014 | Hypothetical protein KIAA1033 | Q2M389 |
| 1015 | Activating signal cointegrator 1 complex subunit 3 (EC 3.6.1.—) | Q8N3C0 |
| 1016 | Delta-interacting protein A (Hepatitis delta antigen-interacting protein A) (Coiled-coil domain-containing protein 85B) | Q15834 |
| 1017 | Hypothetical protein FLJ14466 | Q96BP7 |
| 1018 | Interferon-inducible double stranded RNA-dependent protein kinase activator A | O75569 |
| 1019 | Hypothetical protein C9orf142 | Q9BUH6 |
| 1020 | Tetratricopeptide repeat protein 17 | Q96AE7 |
| 1021 | CDNA FLJ14058 fis, clone HEMBB1000554 | Q9H7Z0 |
| 1022 | Anaphase promoting complex subunit 13 | Q9BS18 |
| 1023 | Hypothetical protein CCDC60 | Q8IWA6 |
| 1024 | Sphingosine kinase 2 (EC 2.7.1.—) | Q9NRA0 |
| 1025 | Probable ATP-dependent RNA helicase DDX11 (EC 3.6.1.—) (DEAD/H box protein 11) (CHL1 homolog) (Keratinocyte growth factor-regulated gene 2 protein) (KRG-2) | Q96FC9 |
| 1026 | Protein KIAA0182 | Q14687 |
| 1027 | Ras GTPase-activating protein SynGAP (Synaptic Ras-GTPase-activating protein 1) (Synaptic Ras-GAP 1) (Neuronal RasGAP) | Q96PV0 |
| 1028 | Fibrinogen C domain containing 1 | Q8N539 |
| 1029 | MGC39581 protein | Q86XM0 |
| 1030 | Bcl-2-like 13 protein (Mil1 protein) (Bcl-rambo) | Q9BXK5 |
| 1031 | Myosin head domain containing 1 | Q96H55 |
| 1032 | WD-repeat protein 51A | Q8NBT0 |
| 1033 | KIF27A (OTTHUMP00000021559) | Q86VH2 |

TABLE 3-continued

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 1034 | Inositol polyphosphate-5-phosphatase F, isoform 1 | Q2T9J4 |
| 1035 | Myopalladin | Q96KF5 |
| 1036 | Rho GTPase activating protein 12 | Q5T2Y2 |
| 1037 | Hypothetical protein DKFZp686D0630 | Q7Z3C5 |
| 1038 | Jumonji domain-containing protein 1C (Thyroid receptor-interacting protein 8) (TRIP-8) | Q15652 |
| 1039 | Coatomer subunit beta (Beta-coat protein) (Beta-COP) | P53618 |
| 1040 | FLJ10462 fis, clone NT2RP1001494, weakly similar to MALE STERILITY PROTEIN 2 | Q9NVW8 |
| 1041 | Cell-cycle and apoptosis regulatory protein 1 | Q6X935 |
| 1042 | Telomere-associated protein RIF1 (Rap1-interacting factor 1 homolog) | Q5UIP0 |
| 1043 | F-box only protein 28 | Q9NVF7 |
| 1044 | CDNA FLJ10901 fis, clone NT2RP5003524 | Q9NV65 |
| 1045 | Acetoacetyl-CoA synthetase (EC 6.2.1.16) | Q86V21 |
| 1046 | Putative cell cycle control protein (DEP domain containing 1) | Q9NXZ0 |
| 1047 | Synaptopodin 2-like | Q68A20 |
| 1048 | CDNA FLJ36560 fis, clone TRACH2009340 | Q8N9T8 |
| 1049 | CDNA FLJ13330 fis, clone OVARC1001802 | Q9H8Q0 |
| 1050 | ATP-dependent RNA helicase DDX31 (EC 3.6.1.—) (DEAD box protein 31) (Helicain) | Q9H8H2 |
| 1051 | Protein C14orf161 | Q9H7T0 |
| 1052 | Cysteine protease ATG4B (EC 3.4.22.—) (Autophagy-related protein 4 homolog B) | Q9Y4P1 |
| 1053 | CDNA FLJ14526 fis, clone NT2RM1001139 | Q96T08 |
| 1054 | Hypothetical protein CCDC77 (CDNA FLJ14732 fis, clone NT2RP3001969, weakly similar to TRICHOHYALIN) | Q9BR77 |
| 1055 | CDNA FLJ14790 fis, clone NT2RP4000973, weakly similar to PROBABLE PROTEIN DISULFIDE ISOMERASE P5 (EC 5.3.4.1) | Q96K38 |
| 1056 | Keratin 24 | Q2M2I5 |
| 1057 | BCoR protein (BCL-6 corepressor) | Q6W2J9 |
| 1058 | Hypothetical protein FLJ20582 | Q6IQ21 |
| 1059 | Hypothetical protein FLJ22688 | Q9BT04 |
| 1060 | Hypothetical protein FLJ22944 | Q9H5W3 |
| 1061 | Zinc finger protein, subfamily 1A, 5- | Q8TBE5 |
| 1062 | Leucine-rich repeats and IQ motif containing 2 | Q8IW35 |
| 1063 | Hypothetical protein FLJ23749 | Q8TEA0 |
| 1064 | Hypothetical protein FLJ25336 | http://www.expasy.org/sprot/userman.html AC lineQ96LP1 |
| 1065 | Hypothetical protein FLJ25660 | Q8N7G6 |
| 1066 | CDNA FLJ30058 fis, clone ADRGL2000074, weakly similar to RHO-GTPASE-ACTIVATING PROTEIN 6 | Q96NU6 |
| 1067 | CDNA FLJ30106 fis, clone BNGH41000190, weakly similar to *Rattus norvegicus* schlafen-4 (SLFN-4) mRNA. | Q96A82 |
| 1068 | Whirlin | Q9P202 |
| 1069 | CDNA FLJ31846 fis, clone NT2RP7000425, weakly similar to MYOSIN HEAVY CHAIN, NONMUSCLE TYPE B | Q96MV0 |
| 1070 | FLJ32833 fis, clone TESTI2003228 | Q96M43 |
| 1071 | Guanine nucleotide-binding protein G(olf), alpha subunit (Adenylate cyclase-stimulating G alpha protein, olfactory type) | P38405 |
| 1072 | CDNA FLJ33811 fis, clone CTONG2002095 | Q8N279 |
| 1073 | Transmembrane protein 16C | Q9BYT9 |
| 1074 | Zinc finger protein 31 (Zinc finger protein KOX29) (Zinc finger and SCAN domain-containing protein 20) (Zinc finger protein 360) | P17040 |
| 1075 | Transmembrane 6 superfamily member 2 | Q9BZW4 |
| 1076 | CDNA FLJ90251 fis, clone NT2RM4000115 | Q8NCH3 |
| 1077 | CDNA FLJ90760 fis, clone THYRO1000061 | Q8N2I4 |
| 1078 | Tubulin--tyrosine ligase-like protein 12 | Q14166 |
| 1079 | KIAA0303 protein | O15021 |
| 1080 | Plexin-B2 precursor (MM1) | O15031 |
| 1081 | Zinc finger and BTB domain-containing protein 5 | O15062 |
| 1082 | Centrosome-associated protein 350 | Q8WY20 |
| 1083 | piccolo (Aczonin) | Q9Y6V0 |
| 1084 | KIAA0560 protein | O60306 |
| 1085 | KIAA0676 protein | Q96H49 |
| 1086 | Human homolog of Mus SLIT and NTRK-like protein 5 precursor | Q8IOB7 |

TABLE 3-continued

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 1087 | Nischarin | Q6PIB4 |
| 1088 | FERM domain-containing protein 4A | Q9P2Q2 |
| 1089 | Leucine-rich repeats neuronal protein 1 precursor (Neuronal leucine-rich repeat protein 1) (NLRR-1) | Q6UXK5 |
| 1090 | KIAA1512 protein | Q9P216 |
| 1091 | KIAA1598 protein | Q9HCH4 |
| 1092 | Phosphatidylinositol-3 phosphate 3-phosphatase adaptor subunit | Q96QU2 |
| 1093 | KIAA1730 protein | Q9C0D3 |
| 1094 | KIAA1786 protein | Q96JN9 |
| 1095 | Hypothetical protein MGC20470 | Q96EK3 |
| 1096 | OACT1 protein | Q86XC2 |
| 1097 | 6-phosphofructo-2-kinase/fructose-2,6-biphosphatase 4 (6PF-2-K/Fru-2,6-P2ASE testis-type isozyme) | Q16877 |
| 1098 | IkappaB kinase complex-associated protein (IKK complex-associated protein) (p150) | O95163 |
| 1099 | Immune receptor expressed on myeloid cells 2 | Q7Z7I3 |
| 1100 | High-affinity cAMP-specific and IBMX-insensitive 3',5'-cyclic phosphodiesterase 8A (EC 3.1.4.17) | O60658 |
| 1101 | Bone specific CMF608 | Q6WRI0 |
| 1102 | Importin alpha-7 subunit (Karyopherin alpha-6) | O60684 |
| 1103 | InaD-like protein (Inadl protein) (hINADL) (Pals1-associated tight junction protein) (Protein associated to tight junctions) | Q8NI35 |
| 1104 | Nitric oxide synthase, inducible (EC 1.14.13.39) | P35228 |
| 1105 | Transcription elongation factor SPT5 (hSPT5) | O00267 |
| 1106 | Inositol-trisphosphate 3-kinase B (EC 2.7.1.127) (Inositol 1,4,5-trisphosphate 3-kinase B) | P27987 |
| 1107 | Type I inositol-3,4-bisphosphate 4-phosphatase (EC 3.1.3.66) (Inositol polyphosphate 4-phosphatase type I) | Q96PE3 |
| 1108 | Insulin receptor beta subunit | Q9UCB7 |
| 1109 | Insulin-like growth factor binding protein, acid labile subunit | Q8TAY0 |
| 1110 | Integrin beta-4 precursor (GP150) (CD104 antigen) | P16144 |
| 1111 | Splice isoform 2 of P35462 | P35462-2 |
| 1112 | Interferon alpha 2 protein | Q16055 |
| 1113 | Interferon-induced protein with tetratricopeptide repeats 1 (IFIT-1)) (Interferon-induced 56 kDa protein) (IFI-56K) | P09914 |
| 1114 | Interleukin-20 precursor (IL-20) (Four alpha helix cytokine Zcyto10) | Q9NYY1 |
| 1115 | Steroid receptor RNA activator isoform 1 | Q9HD15 |
| 1116 | Intersectin-2 (SH3 domain-containing protein 1B) (SH3P18) (SH3P18-like WASP-associated protein) | Q9NZM3 |
| 11117 | ITI-like protein (Inter-alpha (Globulin) inhibitor H5-like) | Q6UXX5 |
| 1118 | Gap junction alpha-5 protein (Connexin-40) | P36382 |
| 1119 | Kelch-like protein 8 | Q9P2G9 |
| 1120 | Keratin, type II cytoskeletal 1 (Cytokeratin-1) | P04264 |
| 1121 | ADAM 9 precursor (EC 3.4.24.—) (A disintegrin and metalloproteinase domain 9) (Metalloprotease/disintegrin/cysteine-rich protein 9) (Myeloma cell metalloproteinase) | Q13443 |
| 1122 | Next to BRCA1 gene 1 protein (Neighbor of BRCA1 gene 1 protein) (Membrane component, chromosome 17, surface marker 2) (1A1-3B) | Q14596 |
| 1123 | Hypothetical protein DKFZp686K2075 | Q6MZZ8 |
| 1124 | KIAA0100 protein | Q14667 |
| 1125 | Pre-mRNA-splicing factor ATP-dependent RNA helicase PRP16 (EC 3.6.1.—) (ATP-dependent RNA helicase DHX38) (DEAH box protein 38) | Q92620 |
| 1126 | KIAA0251 protein | Q8TBS5 |
| 1127 | HUMAN KIAA0342 protein | O15050 |
| 1128 | KIAA0357 protein | O15064 |
| 1129 | Hypothetical protein KIAA0372 | Q6PGP7 |
| 1130 | KIAA0377 splice variant 2 | Q86TE7 |
| 1131 | KIAA0386 protein | Q9Y4F9 |
| 1132 | HUMAN CTCL tumor antigen HD-CL-04 | Q548S1 |
| 1133 | Importin-13 (Imp13) (Ran-binding protein 13) | O94829 |
| 1134 | KIAA0769 protein | O94868 |
| 1135 | Hypothetical protein KIAA0863 | Q6IQ32 |

TABLE 3-continued

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 1136 | Zinc finger protein KIAA1196 - | Q96KM6 |
| 1137 | CRSP complex subunit 3 (Cofactor required for Sp1 transcriptional activation subunit 3) (Transcriptional coactivator CRSP130) (Vitamin D3 receptor-interacting protein complex 130 kDa component | Q9ULK4 |
| 1138 | [Pyruvate dehydrogenase [lipoamide]]-phosphatase 2, mitochondrial precursor (EC 3.1.3.43) | Q9P2J9 |
| 1139 | Protocadherin-10 precursor | Q9P2E7 |
| 1140 | Leucine-rich repeats and calponin homology (CH) domain containing 2 | Q5VUJ6 |
| 1141 | Ankyrin repeat domain 18B | Q5W0G2 |
| 1142 | Kin17 protein (HsKin17 protein) (KIN, antigenic determinant of recA protein homolog) | O60870 |
| 1143 | Kinesin-like protein KIF13A (Kinesin-like protein RBKIN) | Q9H1H9 |
| 1144 | Putative RNA binding protein KOC | O00425 |
| 1145 | Keratin, type I cytoskeletal 18 (Cytokeratin-18) | P05783 |
| 1146 | Kv3.2d voltage-gated potassium channel | Q86W09 |
| 1147 | Lethal(3)malignant brain tumor-like protein (L(3)mbt-like) (L(3)mbt protein homolog) | Q9Y468 |
| 1148 | Lactadherin precursor (Milk fat globule-EGF factor 8) (MFG-E8) (HMFG) (Breast epithelial antigen BA46) (MFGM) | Q08431 |
| 1149 | Lamin-A/C (70 kDa lamin) | P02545 |
| 1150 | Laminin gamma-1 chain precursor (Laminin B2 chain) | P11047 |
| 1151 | Low-density lipoprotein receptor-related protein 5 precursor | O75197 |
| 1152 | Leptin receptor precursor (LEP-R) (OB receptor) | P48357 |
| 1153 | Mitogen-activated protein kinase kinase kinase 13 (EC 2.7.11.25) | O43283 |
| 1154 | Leukemia virus receptor 2 | Q08357 |
| 1155 | Leukemia-associated protein with a CXXC domain | Q8NFU7 |
| 1156 | RNA-binding protein 6 (RNA-binding motif protein 6) (RNA-binding protein DEF-3) (Lung cancer antigen NY-LU-12) | P78332 |
| 1157 | Lung cancer oncogene 5 | Q7Z5Q7 |
| 1158 | Heterogeneous nuclear ribonucleoprotein M (hnRNP M) | P52272 |
| 1159 | Macrophage migration inhibitory factor (MIF) (Phenylpyruvate tautomerase) (EC 5.3.2.1) | P14174 |
| 1160 | Mitotic spindle assembly checkpoint protein MAD2B (MAD2-like 2) (hREV7) | Q9UI95 |
| 1161 | Mitogen-activated protein kinase kinase kinase 4 (EC 2.7.11.25) (MAPK/ERK kinase kinase 4) | Q9Y6R4 |
| 1162 | Serine/threonine/tyrosine-interacting-like protein 1 (Dual-specificity protein phosphatase 24) (Map kinase phosphatase-like protein MK-STYX) | Q9Y6J8 |
| 1163 | Microtubule-associated serine/threonine-protein kinase 2 (EC 2.7.11.1) | Q6P0Q8 |
| 1164 | Matrix metalloprotease MMP-27 | Q9H306 |
| 1165 | MCM10 protein | Q7L590 |
| 1166 | Interferon-induced helicase C domain-containing protein 1 (EC 3.6.1.—) (Melanoma differentiation-associated protein 5) | Q9BYX4 |
| 1167 | Melanoma ubiquitous mutated protein | Q2TAK8 |
| 1168 | Melanoma antigen family D, 2 | Q5BJF3 |
| 1169 | Melanocyte protein Pmel 17 precursor (Melanocyte lineage-specific antigen GP100) | P40967 |
| 1170 | GPI-anchored protein p137 (p137GPI) (Membrane component chromosome 11 surface marker 1) Cytoplasmic activation/proliferation-associated protein 1 | Q14444 |
| 1171 | Hepatocyte growth factor receptor precursor (EC 2.7.10.1) (HGF receptor) (Scatter factor receptor) (SF receptor) (HGF/SF receptor) (Met proto-oncogene tyrosine kinase) | P08581 |
| 1172 | Mitogen-activated protein kinase 14 (EC 2.7.11.24) | Q16539 |
| 1173 | Mitogen-activated protein kinase kinase kinase 2 (EC 2.7.11.1) (MAPK/ERK kinase kinase 2) | Q12851 |
| 1174 | Mitotic kinesin-related protein | Q96Q89 |
| 1175 | Sperm-associated antigen 5 (Astrin) (Mitotic spindle-associated protein p126) | Q96R06 |
| 1176 | Myeloid/lymphoid or mixed-lineage leukemia protein 4 (Trithorax homolog 2) | Q9UMN6 |
| 1177 | Putative helicase MOV-10 (EC 3.6.1.—) (Moloney leukemia virus 10 protein) | Q9HCE1 |

TABLE 3-continued

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 1178 | MOZ/CBP protein | Q712H6 |
| 1179 | Calgranulin B (Migration inhibitory factor-related protein 14) (MRP-14) (P14) | P06702 |
| 1180 | MUC2_HUMAN Mucin-2 precursor (Intestinal mucin 2) | Q02817 |
| 1181 | Mucin-5B precursor (Mucin 5 subtype B, tracheobronchial) | Q9HC84 |
| 1182 | Multiple PDZ domain protein (Multi PDZ domain protein 1) (Multi-PDZ-domain protein 1) | O75970 |
| 1183 | RUFY2 (Run and FYVE domain-containing protein Rabip4 | Q8IW33 |
| 1184 | Multidrug resistance-associated protein 7 | Q8NHX7 |
| 1185 | Multiple copies in a T-cell malignancies (Malignant T cell amplified sequence 1) (MCT1) | Q9ULC4 |
| 1186 | DNA mismatch repair protein Msh3 | P20585 |
| 1187 | Protein CBFA2T2 (MTG8-like protein) (MTG8-related protein 1) (Myeloid translocation-related protein 1) | O43439 |
| 1188 | Myomesin-1 (190 kDa titin-associated protein) (190 kDa connectin-associated protein | P52179 |
| 1189 | Myosin heavy chain, cardiac muscle beta isoform (MyHC-beta) | P12883 |
| 1190 | Myosin-13 (Myosin heavy chain, skeletal muscle, extraocular) (MyHC-eo) | Q9UKX3 |
| 1191 | Tumor suppressor candidate 3 (N33 protein) | Q13454 |
| 1192 | Nebulin-related anchoring protein | Q8TCH0 |
| 1193 | Neural cell adhesion molecule 1, 1 | P13592 |
| 1194 | Neurotrimin precursor | Q9P121 |
| 1195 | Ninein | Q8N4C6 |
| 1196 | Notch homolog 2 | Q5VTD0 |
| 1197 | Neurogenic locus notch homolog protein 1 precursor (Notch 1) (hN1) (Translocation-associated notch protein TAN-1) [Contains: Notch 1 extracellular truncation; Notch 1 intracellular domain] | P46531 |
| 1198 | Neurogenic locus notch homolog protein 3 precursor (Notch 3) [Contains: Notch 3 extracellular truncation; Notch 3 intracellular domain] | Q9UM47 |
| 1199 | Neurogenic locus notch homolog protein 4 precursor (Notch 4) (hNotch4) [Contains: Notch 4 extracellular truncation; Notch 4 intracellular domain] - | Q99466 |
| 1200 | Plexin-A1 precursor (Semaphorin receptor NOV) | Q9UIW2 |
| 1201 | HUMAN NPD011 | Q9H2R7 |
| 1202 | Nuclear autoantigen Sp-100 (Speckled 100 kDa) (Nuclear dot-associated Sp100 protein) | P23497 |
| 1203 | Nuclear factor erythroid 2-related factor 1 (NF-E2-related factor 1) (NFE2-related factor 1) (Nuclear factor, erythroid derived 2, like 1) (Transcription factor 11) (Transcription factor HBZ17) (Transcription factor LCR-F1) (Locus control region-factor 1) | Q14494 |
| 1204 | Nuclear factor of activated T-cells, cytoplasmic 1 (NFAT transcription complex cytosolic component) (NF-ATc1) | O95644 |
| 1205 | Nuclear receptor coactivator 2 (NCoA-2) (Transcriptional intermediary factor 2) | Q15596 |
| 1206 | Ubiquitin-like PHD and RING finger domain-containing protein 1 (EC 6.3.2.—) | Q96T88 |
| 1207 | Nucleic acid helicase DDXx | Q8IWW2 |
| 1208 | Nucleoporin 62 kDa (NUP62 protein) | Q6GTM2 |
| 1209 | Nuclear pore complex protein Nup98-Nup96 precursor [Contains: Nuclear pore complex protein Nup98 (Nucleoporin Nup98) (98 kDa nucleoporin); | P52948 |
| 1210 | Nucleoprotein TPR | P12270 |
| 1211 | Nuclear pore complex protein Nup107 | P57740 |
| 1212 | Nuclear pore complex protein Nup205 | Q92621 |
| 1213 | ODF2 protein | Q6PJQ8 |
| 1214 | Trophoblast glycoprotein precursor (5T4 oncofetal trophoblast glycoprotein) | Q13641 |
| 1215 | Dynamin-like 120 kDa protein, mitochondrial precursor (Optic atrophy 1 gene protein) | O60313 |
| 1216 | Orexin receptor type 2 (Ox2r) (Hypocretin receptor type 2) | O43614 |
| 1217 | Transmembrane emp24 domain-containing protein 10 precursor (Transmembrane protein Tmp21) | P49755 |
| 1218 | Orphan nuclear receptor TR2 (Testicular receptor 2) | P13056 |
| 1219 | MKL/myocardin-like protein 1 (Myocardin-related transcription factor A) (MRTF-A) (Megakaryoblastic leukemia 1 protein) (Megacaryocytic acute leukemia protein) | Q969V6 |

TABLE 3-continued

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 1220 | Ovarian cancer related tumor marker CA125 - | Q8WXI7 |
| 1221 | Oxysterol-binding protein-related protein 8 (OSBP-related protein 8) | Q9BZF1 |
| 1222 | Centrosomal protein of 70 kDa (Cep70 protein) (p10-binding protein) | Q8NHQ1 |
| 1223 | Leucine carboxyl methyltransferase 2 (EC 2.1.1.—) (p21WAF1/CIP1 promoter-interacting protein) | O60294 |
| 1224 | F-box/LRR-repeat protein 5 (F-box and leucine-rich repeat protein 5) (F-box protein FBL4/FBL5) | Q9UKA1 |
| 1225 | Inhibitor of growth protein 3 | Q9NXR8 |
| 1226 | P53 inducible protein | Q9UN29 |
| 1227 | DNA polymerase alpha catalytic subunit (EC 2.7.7.7) | P09884 |
| 1228 | Chloride intracellular channel protein 4 (Intracellular chloride ion channel protein p64H1 | Q9Y696 |
| 1229 | Paired mesoderm homeobox protein 2B (Paired-like homeobox 2B) (PHOX2B homeodomain protein) (Neuroblastoma Phox) | Q99453 |
| 1230 | PRB3 protein | P81489 |
| 1231 | Protein patched homolog 1 (PTC1) (PTC) | Q13635 |
| 1232 | Rap guanine nucleotide exchange factor 2 (Neural RAP guanine nucleotide exchange protein) (nRap GEP) (PDZ domain-containing guanine nucleotide exchange factor 1) (PDZ-GEF1) | Q9Y4G8 |
| 1233 | Pecanex-like protein 1 (Pecanex homolog) - | Q96RV3 |
| 1234 | GC-1-related estrogen receptor alpha coactivator short isoform | Q8TDE4 |
| 1235 | PHD finger | Q86U89 |
| 1236 | Hypothetical protein DKFZp686C07187 | Q6N038 |
| 1237 | Phosphatidylinositol-4,5-bisphosphate 3-kinase catalytic subunit beta isoform (EC 2.7.1.153) (PI3-kinase p110 subunit beta) (PtdIns-3-kinase p110) | P42338 |
| 1238 | Phosphodiesterase 8A, isoform 1 | Q6P9H3 |
| 1239 | Serine/threonine-protein kinase SMG1 (EC 2.7.11.1) (SMG-1) (hSMG-1) (Lambda/iota protein kinase C-interacting protein) (Lambda-interacting protein) ( | Q96Q15 |
| 1240 | PiggyBac transposable element derived 3 | Q8N328 |
| 1241 | PIWIL3 protein | Q7Z3Z3 |
| 1242 | Homeobox protein PKNOX1 (PBX/knotted homeobox 1) | P55347 |
| 1243 | Transmembrane protein 115 (Protein PL6) | Q12893 |
| 1244 | Plakophilin-2 | Q99959 |
| 1245 | Plectin 6 | Q6S380 |
| 1246 | Plectin 1 (PLTN) (PCN) (Hemidesmosomal protein 1) (HD1) | Q15149 |
| 1247 | Plexin B1; plexin 5; semaphorin receptor | O43157 |
| 1248 | Pleiotropic regulator 1 | O43660 |
| 1249 | Blood vessel epicardial substance (hBVES) (Popeye domain-containing protein 1) (Popeye protein 1) | Q8NE79 |
| 1250 | Carboxypeptidase-like protein X2 precursor | Q8N436 |
| 1251 | YIF1B protein | Q5BJH7 |
| 1252 | Melanoma antigen preferentially expressed in tumors (Pr4eferentially expressed antigen of melanoma) (OPA-interacting protein 4) | P78395 |
| 1253 | Splice isoform 2 of Q9H7F0 | Q9H7F0-2 |
| 1254 | P2Y purinoceptor 13 (P2Y13) (G-protein coupled receptor 86) (G-protein coupled receptor 94) | Q9BPV8 |
| 1255 | Putative pre-mRNA-splicing factor ATP-dependent RNA helicase DHX15 (EC 3.6.1.—) (DEAH box protein 15) (ATP-dependent RNA helicase #46) | O43143 |
| 1256 | HUMAN RNA-binding protein 34 (RNA-binding motif protein 34) | P42696 |
| 1257 | Prolyl 4-hydroxylase alpha-1 subunit precursor (EC 1.14.11.2) (4-PH alpha-1) (Procollagen-proline, 2-oxoglutarate-4-dioxygenase alpha-1 subunit) | P13674 |
| 1258 | Profilin-1 | P07737 |
| 1259 | Programmed cell death protein 5 (TFAR19 protein) (TF-1 cell apoptosis-related gene 19 protein) | O14737 |
| 1260 | Propionyl-CoA carboxylase beta chain, mitochondrial precursor (EC 6.4.1.3) | P05166 |
| 1261 | 26S proteasome non-ATPase regulatory subunit 1 (26S proteasome regulatory subunit RPN2) (26S proteasome regulatory subunit S1) (26S proteasome subunit p112) | Q99460 |

TABLE 3-continued

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 1262 | 26S proteasome non-ATPase regulatory subunit 3 (26S proteasome regulatory subunit S3) (Proteasome subunit p58) | O43242 |
| 1263 | Proteasome activator complex subunit 3 (Proteasome activator 28-gamma subunit) (PA28gamma) (PA28g) (Activator of multicatalytic protease subunit 3) (11S regulator complex gamma subunit) (REG-gamma) (Ki nuclear autoantigen) | P61289 |
| 1264 | Protein C14orf166 | Q9Y224 |
| 1265 | Protein KIAA1219 | Q86X10 |
| 1266 | Protein KIAA1688 | Q9C0H5 |
| 1267 | Protein Plunc precursor (Palate lung and nasal epithelium clone protein) (Lung-specific protein X) (Nasopharyngeal carcinoma-related protein) (Tracheal epithelium-enriched protein) (Secretory protein in upper respiratory tracts) | Q9NP55 |
| 1268 | Protein transport protein Sec23B | Q15437 |
| 1269 | Liprin-alpha-2 (Protein tyrosine phosphatase receptor type f polypeptide-interacting protein alpha-2) (PTPRF-interacting protein alpha-2) | O75334 |
| 1270 | Protocadherin gamma A12 precursor (PCDH-gamma-A12) (Cadherin-21) (Fibroblast cadherin 3) | O60330 |
| 1271 | Protocadherin gamma A10 precursor (PCDH-gamma-A10) | Q9Y5H3 |
| 1272 | Leucine carboxyl methyltransferase 2 (EC 2.1.1.—) (p21WAF1/CIP1 promoter-interacting protein) | O60294 |
| 1273 | KIAA1636 protein | Q9HCD6 |
| 1274 | Probable G-protein coupled receptor 160 | Q9UJ42 |
| 1275 | Protein C21orf45 | Q9NYP9 |
| 1276 | Periodic tryptophan protein 2 homolog | Q15269 |
| 1277 | Rab-like protein 2B | Q9UNT1 |
| 1278 | Cell cycle checkpoint protein RAD17 (hRad17) (RF-C/activator 1 homolog) | O75943 |
| 1279 | DNA repair protein RAD50 (EC 3.6.—.—) (hRAD50) | Q92878 |
| 1280 | Ras GTPase-activating protein 1 (GTPase-activating protein) (GAP) (Ras p21 protein activator) (p120GAP) (RasGAP) | P20936 |
| 1281 | Ras guanine nucleotide exchange factor 2 | Q9UK56 |
| 1282 | Ras-GTPase-activating protein-binding protein 1 (EC 3.6.1.—) (ATP-dependent DNA helicase VIII) (GAP SH3-domain-binding protein 1) (G3BP-1) (HDH-VIII) | Q13283 |
| 1283 | Ras-related protein Rab-27A (Rab-27) (GTP-binding protein Ram) | P51159 |
| 1284 | Ras-related protein Rab-3D | O95716 |
| 1285 | Nuclear pore complex protein Nup107 (Nucleoporin Nup107) (107 kDa nucleoporin) | P57740 |
| 1286 | Receptor-interacting factor 1 | Q86XS4 |
| 1287 | Regulating synaptic membrane exocytosis protein 3 (Nim3) (Rab-3 interacting molecule 3) (RIM 3) (RIM3 gamma) | Q9UJD0 |
| 1288 | Regulator of G protein signaling protein (Regulator of G-protein signalling like 1) | Q86UV0 |
| 1289 | MHC class II regulatory factor RFX1 (RFX) (Enhancer factor C) (EF-C) | P22670 |
| 1290 | Retinoblastoma-associated protein (PP110) (P105-RB) | P06400 |
| 1291 | Roundabout homolog 3 precursor (Roundabout-like protein 3) | Q96MS0 |
| 1292 | Retinoblastoma-associated protein HEC (Kinetochore associated 2) | O14777 |
| 1293 | Retinoblastoma-associated protein RAP140 | Q9UK61 |
| 1294 | AT-rich interactive domain-containing protein 4A (ARID domain-containing protein 4A) (Retinoblastoma-binding protein 1) | P29374 |
| 1295 | Jumonji/ARID domain-containing protein 1A (Retinoblastoma-binding protein 2) (RBBP-2) | P29375 |
| 1296 | RhoGTPase regulating protein variant ARHGAP20-1ad | Q6RJU5 |
| 1297 | 40S ribosomal protein S4, Y isoform 2 | Q8TD47 |
| 1298 | RNA binding motif | Q13380 |
| 1299 | RNA binding protein (Autoantigenic, hnRNP-associated with lethal yellow), long isoform - | Q2M365 |
| 1300 | RNA-binding protein | Q8NI52 |
| 1301 | Ro ribonucleoprotein-binding protein 1 (SIAHBP1 protein) | Q9UHX1 |
| 1302 | HUMAN OTTHUMP00000030902 | Q5JYR6 |

TABLE 3-continued

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 1303 | Ryanodine receptor 2 (Cardiac muscle-type ryanodine receptor) (RyR2) (RYR-2) (Cardiac muscle ryanodine receptor-calcium release channel) (hRYR-2) | Q92736 |
| 1304 | SEC14-like protein 1 | Q92503 |
| 1305 | Secreted and transmembrane protein 1 precursor (Protein K12) | Q8WVN6 |
| 1306 | Neudesin precursor (Neuron-derived neurotrophic factor) | Q9UMX5 |
| 1307 | P-selectin glycoprotein ligand 1 precursor (PSGL-1) (Selectin P ligand) (CD162 antigen) | Q14242 |
| 1308 | Semaphorin-6D precursor | Q8NFY4 |
| 1309 | Serine/threonine/tyrosine-interacting protein (Protein tyrosine phosphatase-like protein) | Q8WUJ0 |
| 1310 | Olfactory receptor 8G5 (Olfactory receptor OR11-298) | Q8NG78 |
| 1311 | Shb-like adapter protein, Shf | Q7M4L6 |
| 1312 | Signal transducer and activator of transcription 1-alpha/beta (Transcription factor ISGF-3 components p91/p84) STAT1 | P42224 |
| 1313 | Signal transducer and activator of transcription 3 (Acute-phase response factor) | P40763 |
| 1314 | 40S ribosomal protein S7 | P62081 |
| 1315 | 60S ribosomal protein L35 | P42766 |
| 1316 | 60S ribosomal protein L7 | P18124 |
| 1317 | Thrombospondin-2 precursor | P35442 |
| 1318 | C3 and PZP-like alpha-2-macroglobulin domain containing 8 | Q8IZJ3 |
| 1319 | ATP-binding cassette sub-family F member 2 (Iron-inhibited ABC transporter 2) | Q9UG63 |
| 1320 | Ribosome biogenesis protein BOP1 (Block of proliferation 1 protein) | Q14137 |
| 1321 | CDNA FLJ13765 fis, clone PLACE4000128, weakly similar to Mus musculus putative transcription factor mRNA | Q9H8C5 |
| 1322 | CD200 cell surface glycoprotein receptor isoform 2 variant 2 | Q6Q8B3 |
| 1323 | LRRC58 protein | Q96CX6 |
| 1324 | Claudin-6 (Skullin 2) | P56747 |
| 1325 | T-box transcription factor TBX18 (T-box protein 18) | O95935 |
| 1326 | INTS7 protein | Q8WUH5 |
| 1327 | FRAS1-related extracellular matrix protein 2 precursor (ECM3 homolog) | Q5SZK8 |
| 1328 | Zinc finger protein 318 (Endocrine regulatory protein) | Q5VUA4 |
| 1329 | Eukaryotic translation initiation factor 3 subunit 8 (eIF3 p110) (eIF3c) | Q99613 |
| 1330 | HUMAN LOC196394 protein | Q8IY45 |
| 1331 | Hypothetical protein FLJ44216 | Q8NDZ2 |
| 1332 | Heat shock protein HSP 90-beta (HSP 84) (HSP 90) | P08238 |
| 1333 | Sarcoma antigen NY-SAR-41 (NY-SAR-41) | Q5T9S5 |
| 1334 | Protein FAM86A | Q96G04 |
| 1335 | Ras-like family 11 member A (OTTHUMP00000018162) | Q6T310 |
| 1336 | Keratin, type I cytoskeletal 18 (Cytokeratin-18) (CK-18) | P05783 |
| 1337 | U3 small nucleolar RNA-associated protein 14 homolog A (Antigen NY-CO-16) | Q9BVJ6 |
| 1338 | Hypothetical protein DKFZp781D1722 | Q68DM0 |
| 1339 | Chromosome-associated kinesin KIF4A (Chromokinesin) | O95239 |
| 1340 | Kinesin-like protein KIF6 | Q6ZMV9 |
| 1341 | Myosin-10 (Myosin heavy chain, nonmuscle IIb) (Nonmuscle myosin heavy chain IIb) | P35580 |
| 1342 | Hypothetical protein C17orf57 | Q8IY85 |
| 1343 | Similar to peptide N-glycanase homolog (S. cerevisiae) | Q9BVR8 |
| 1344 | Peptidyl-prolyl cis-trans isomerase A (EC 5.2.1.8) | P62937 |
| 1345 | Serpin A13 precursor | Q6UXR4 |
| 1346 | 40S ribosomal protein SA (p40) (34/67 kDa laminin receptor) (Colon carcinoma laminin-binding protein) (NEM/1CHD4) (Multidrug resistance-associated protein MGr1-Ag) | P08865 |
| 1347 | N-acetylglucosamine-1-phosphotransferase subunit gamma precursor | Q9UJJ9 |
| 1348 | Liprin-beta-1 (Protein tyrosine phosphatase receptor type f polypeptide-interacting protein-binding protein 1) | Q86W92 |
| 1349 | 40S ribosomal protein S3a | P61247 |
| 1350 | 40S ribosomal protein S3a | P61247 |
| 1351 | LOC124512 protein (Fragment) | Q86XA0 |
| 1532 | Hypothetical protein MGC26744 | Q96KX1 |
| 1535 | Hypothetical protein LOC122258 | Q96KW9 |
| 1354 | Sulfiredoxin-1 (EC 1.8.98.2) | Q9BYN0 |

TABLE 3-continued

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 1355 | Basalin | Q5QJ38 |
| 1356 | Protein FAM86A | Q96G04 |
| 1357 | Transmembrane protein 16F | Q4KMQ2 |
| 1358 | TEB4 protein | O14670 |
| 1359 | SLC10A5 | Q5PT55 |
| 1360 | Serine/threonine-protein kinase SNF1-like kinase 1 (EC 2.7.11.1) | P57059 |
| 1361 | LOC391257 protein | Q6P094 |
| 1362 | Zinc finger protein 161 (Putative transcription factor DB1) | Q14119 |
| 1363 | Slit homolog 2 protein precursor (Slit-2) | O94813 |
| 1364 | FYN-binding protein (FYN-T-binding protein) | O15117 |
| 1365 | Jumonji/ARID domain-containing protein 1C (SmcX protein) (Xe169 protein) | P41229 |
| 1366 | Jumonji/ARID domain-containing protein 1D (SmcY protein) (Histocompatibility Y antigen) | Q9BY66 |
| 1367 | Monocarboxylate transporter 3 (MCT 3) | O95907 |
| 1368 | Solute carrier family 4 sodium bicarbonate cotransporter-like member 10 - | Q6U841 |
| 1369 | Sorting nexin 14, isoform a | Q6NUI7 |
| 1370 | Sorting nexin-4 | O95219 |
| 1371 | Spectrin beta chain, brain 4 (Spectrin, non-erythroid beta chain 4) | Q9NRC6 |
| 1372 | Spermatogenesis-associated protein 7 (Spermatogenesis-associated protein HSD3) | Q9P0W8 |
| 1373 | Non-POU domain-containing octamer-binding protein (NonO protein) (54 kDa nuclear RNA- and DNA-binding protein) (p54(nrb)) (p54nrb) (55 kDa nuclear protein) | Q15233 |
| 1374 | Cohesin subunit SA-1 (Stromal antigen 1) (SCC3 homolog 1) | Q8WVM7 |
| 1375 | Steroid receptor RNA activator isoform 1 | Q9HD15 |
| 1376 | Structure-specific recognition protein 1 (SSRP1) (Recombination signal sequence recognition protein) (T160) (Chromatin-specific transcription elongation factor 80 kDa subunit) | Q08945 |
| 1377 | Suppressor of hairy wing homolog 2 (5'OY11.1) (Zinc finger protein 632) | Q86YH2 |
| 1378 | Transcription elongation factor SPT5 (hSPT5) (DRB sensitivity-inducing factor large subunit) (DSIF large subunit) (DSIF p160) (Tat-cotransactivator 1 protein) (Tat-CT1 protein) - | O00267 |
| 1379 | Synaptogyrin-3 | O43761 |
| 1380 | Synaptojanin-2-binding protein (Mitochondrial outer membrane protein 25) | P57105 |
| 1381 | Synemin | Q8TE61 |
| 1382 | Talin-1 | Q9Y490 |
| 1383 | TAR RNA loop binding protein (TAR (HIV) RNA binding protein 1) | Q13395 |
| 1384 | Taste receptor type 2 member 3 (T2R3) | Q9NYW6 |
| 1385 | Taste receptor type 2 member 40 (T2R40) (T2R58) (G-protein coupled receptor 60) | P59535 |
| 1386 | Oxidoreductase HTATIP2 (EC 1.1.1.—) (HIV-1 TAT-interactive protein 2) | Q9BUP3 |
| 1387 | Transcription initiation factor TFIID subunit 6 (Transcription initiation factor TFIID 70 kDa subunit) (TAF(II)70) (TAFII-70) (TAFII-80) (TAFII80) | P49848 |
| 1388 | TRA@ protein | Q6PIP7 |
| 1389 | T-complex protein 1 subunit beta (TCP-1-beta) (CCT-beta) | P78371 |
| 1390 | Telomerase-binding protein EST1A (Ever shorter telomeres 1A) (Telomerase subunit EST1A) (EST1-like protein A) (hSmg5/7a) | Q86US8 |
| 1391 | Tumor endothelial marker 6 (Hypothetical protein TEM6) | Q96PE0 |
| 1392 | Ras GTPase-activating-like protein IQGAP2 | Q13576 |
| 1393 | Tetratricopeptide repeat protein 15 (TPR repeat protein 15) | Q8WVT3 |
| 1394 | Myosin-18A (Myosin XVIIIa) (Myosin containing PDZ domain) (Molecule associated with JAK3 N-terminus) (MAJN) | Q92614 |
| 1395 | Polycystic kidney and hepatic disease 1 precursor (Fibrocystin) | Q8TCZ9 |
| 1396 | TMC4 protein | Q7Z5M3 |
| 1397 | MDC-3.13 isoform 1 (TNFAIP8 protein) | Q9UER5 |
| 1398 | Toll-like receptor 8 precursor | Q9NR97 |
| 1399 | Tolloid-like protein 1 precursor (EC 3.4.24.—) | O43897 |

TABLE 3-continued

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 1400 | DNA topoisomerase I, mitochondrial precursor (EC 5.99.1.2) (TOP1mt) | Q969P6 |
| 1401 | PAP associated domain-containing protein 5 (EC 2.7.7.—) (Topoisomerase-related function protein 4-2) (TRF4-2) | Q8NDF8 |
| 1402 | Plastin-3 (T-plastin) | P13797 |
| 1403 | Translocated promoter region (To activated MET oncogene) | Q5SWY0 |
| 1404 | P2Y purinoceptor 13 (P2Y13) (G-protein coupled receptor 86) (G-protein coupled receptor 94) | Q9BPV8 |
| 1405 | Transcript Y 5 | Q9BXH6 |
| 1406 | Transcription factor Sp4 (SPR-1) | Q02446 |
| 1407 | Transcription initiation factor TFIID subunit 1 (EC 2.7.11.1) (Transcription initiation factor TFIID 250 kDa subunit) (TAF(II)250) (TAFII-250) (TAFII250) (TBP-associated factor 250 kDa) (p250) (Cell cycle gene 1 protein) | P21675 |
| 1408 | Transcriptional repressor CTCFL (CCCTC-binding factor) (Brother of the regulator of imprinted sites) (Zinc finger protein CTCF-T) (CTCF paralog | Q8NI51 |
| 1409 | Transducer of regulated CREB protein 3 | Q6UUV7 |
| 1410 | Transmembrane channel-like protein 4 | Q7Z404 |
| 1411 | Transcription initiation factor TFIID subunit 6 (Transcription initiation factor TFIID 70 kDa subunit) (TAF(II)70) (TAFII-70) (TAFII-80) (TAFII80) | P49848 |
| 1412 | Trophinin-associated protein (Tastin) (Trophinin-assisting protein) | Q12815 |
| 1413 | Tryptophanyl-tRNA synthetase (EC 6.1.1.2) (Tryptophan--tRNA ligase) (TrpRS) (IFP53) (hWRS) | P23381 |
| 1414 | Tubulin, gamma complex associated protein 3 | Q5T9Y2 |
| 1415 | Tumor necrosis factor ligand superfamily member 6 (Fas antigen ligand) (Fas ligand) (CD178 antigen) (CD95L protein) (Apoptosis antigen ligand) (APTL) [Contains: Tumor necrosis factor ligand superfamily member 6, membrane form | P48023 |
| 1416 | Tumor necrosis factor, alpha-induced protein 1, endothelial (B12 protein) | Q13829 |
| 1417 | Netrin receptor DCC precursor (Tumor suppressor protein DCC) (Colorectal cancer suppressor) | P43146 |
| 1418 | Adipocyte-derived leucine aminopeptidase precursor (EC 3.4.11.—) (A-LAP) (ARTS-1) (Aminopeptidase PILS) (Puromycin-insensitive leucyl-specific aminopeptidase) (PILS-AP) (Type 1 tumor necrosis factor receptor shedding aminopeptidase | Q9NZ08 |
| 1419 | U1 small nuclear ribonucleoprotein A (U1 snRNP protein A) (U1A protein) (U1-A) | P09012 |
| 1420 | U6 snRNA-associated Sm-like protein LSm8 | O95777 |
| 1421 | Ubiquitin-protein ligase E3A (EC 6.3.2.—) (E6AP ubiquitin-protein ligase) (Oncogenic protein-associated protein E6-AP) (Human papillomavirus E6-associated protein) | Q05086 |
| 1422 | Ubiquitin carboxyl-terminal hydrolase 3 (EC 3.1.2.15) (Ubiquitin thioesterase 3) (Ubiquitin-specific-processing protease 3) (Deubiquitinating enzyme 3) | Q9Y6I4 |
| 1423 | UBX domain-containing protein 2 | Q92575 |
| 1424 | UNC93 homolog B1 (UNC-93B protein) (hUNC93B1) | Q9H1C4 |
| 1425 | Splice isoform 5 of Q9H171 | Q9H171-5 |
| 1426 | CDNA FLJ46282 fis, clone TESTI4031066 | Q6ZRK6 |
| 1427 | CCDC73 protein | Q6P5Q7 |
| 1428 | Caspase recruitment domain-containing protein 10 (CARD-containing MAGUK protein 3) (Carma 3) | Q9BWT7 |
| 1429 | Chromatin-specific transcription elongation factor FACT 140 kDa subunit | Q9Y5B9 |
| 1430 | Beta-defensin 120 precursor | Q8N689 |
| 1431 | Alpha-catulin (Catenin alpha-like protein 1) (Alpha-catenin-related protein) | Q9UBT7 |
| 1432 | Ribonuclease III (EC 3.1.26.3) (RNase III) | Q9NRR4 |
| 1433 | Seizure related 6 homolog | Q53EL9 |
| 1434 | Granulocyte colony-stimulating factor precursor (G-CSF) (Pluripoietin) (Filgrastim) (Lenograstim) | P09919 |
| 1435 | Lysyl-tRNA synthetase | Q9HB23 |
| 1436 | Protein C6orf130 | Q9Y530 |
| 1437 | Melanophilin (Exophilin-3) (Synaptotagmin-like protein 2a) (Slp homolog lacking C2 domains a) | Q9BV36 |

TABLE 3-continued

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 1438 | Novel protein (Possible ortholog of mouse phosphoinositide-3-kinase adaptor protein 1 (Pik3ap1) | Q5VTR6 |
| 1439 | AER61 glycosyltransferase | Q6P985 |
| 1440 | Heat shock protein HSP 90-alpha (HSP 86) | P07900 |
| 1441 | 60S ribosomal protein L19 | P84098 |
| 1442 | PDZ domain-containing protein 11 | Q5EBL8 |
| 1443 | Dedicator of cytokinesis 11-; Cdc42-associated guanine nucleotide exchange factor ACG/DOCK11 | Q5JSL3 |
| 1444 | Hypothetical protein FLJ26930 | Q6ZNX6 |
| 1445 | Laminin gamma-1 chain precursor (Laminin B2 chain) | P11047 |
| 1446 | ATP-binding cassette transporter sub-family C member 11 (Multidrug resistance-associated protein 8) | Q96J66 |
| 1447 | Uridine/cytidine kinase-like 1 | Q9NWZ5 |
| 1448 | Butyrophilin-like protein 8 precursor | Q6UX41 |
| 1449 | Endothelial cell-selective adhesion molecule precursor | Q96AP7 |
| 1450 | Poly(A)-specific ribonuclease PARN (EC 3.1.13.4) (Polyadenylate-specific ribonuclease) (Deadenylating nuclease) (Deadenylation nuclease) | O95453 |
| 1451 | Voltage-gated potassium channel KCNA7 | Q96RP8 |
| 1452 | F-box protein 11 | Q52ZP1 |
| 1453 | rythrocyte membrane protein band 4.1 like 5 | Q7Z5S1 |
| 1454 | CDNA FLJ45015 fis, clone BRAWH3014639 | Q6ZT30 |
| 1455 | FAM13A1_v2 protein | Q24JP0 |
| 1456 | Hypothetical protein FLJ26432 | Q6ZP70 |
| 1457 | VPS13D-1A protein | Q709C5 |
| 1458 | Coagulation factor VIII precursor (Procoagulant component) (Antihemophilic factor) (AHF) | P00451 |
| 1459 | NFX1-type zinc finger-containing protein 1 | Q9P2E3 |
| 1460 | Polymerase I and transcript release factor (PTRF protein) | Q6NZI2 |
| 1461 | T-complex protein 1 subunit epsilon (TCP-1-epsilon) (CCT-epsilon) | P48643 |
| 1462 | Probable ATP-dependent RNA helicase DDX27 (EC 3.6.1.—) (DEAD box protein 27) | Q96GQ7 |
| 1463 | HSCARG | Q9HBL8 |
| 1464 | CDNA FLJ43956 fis, clone TESTI4015681 | Q6ZU72 |
| 1465 | Mitochondrial-processing peptidase alpha subunit, mitochondrial precursor (EC 3.4.24.64) (Alpha-MPP) | Q10713 |
| 1466 | CDNA FLJ45287 fis, clone BRHIP3002124 | Q6ZSR0 |
| 1467 | Hypothetical protein C12orf62 | Q96I36 |
| 1468 | VPS13D-2A protein | Q709C4 |
| 1469 | CDNA FLJ32009 fis, clone NT2RP7009498, weakly similar to FIBULIN-1, ISOFORM A | Q96DN2 |
| 1470 | Transient receptor potential cation channel subfamily V member 4 (TrpV4) (osm-9-like TRP channel 4) (OTRPC4) (Vanilloid receptor-like channel 2) (Vanilloid receptor-like protein 2) (VRL-2) | Q9HBA0 |
| 1471 | Vascular endothelial growth factor D precursor (VEGF-D) (c-fos-induced growth factor) (FIGF) | O43915 |
| 1472 | Vascular endothelial growth factor receptor 1 precursor (EC 2.7.10.1) (VEGFR-1) (Vascular permeability factor receptor) (Tyrosine-protein kinase receptor FLT) (Flt-1) (Tyrosine-protein kinase FRT) (Fms-like tyrosine kinase 1) | P17948 |
| 1473 | Proto-oncogene C-crk (P38) (Adapter molecule crk) | P46108 |
| 1474 | VDUP1 protein (Thioredoxin interacting protein) | Q9H3M7 |
| 1475 | Vimentin | P08670 |
| 1476 | HUMAN CTCL tumor antigen HD-CL-06 (Vimentin variant) | Q548L2 |
| 1477 | Vinculin (Metavinculin) | P18206 |
| 1478 | Integrin alpha-3 precursor (Galactoprotein B3) (GAPB3) (VLA-3 alpha chain) (FRP-2) (CD49c antigen) [Contains: Integrin alpha-3 heavy chain; Integrin alpha-3 light chain] | P26006 |
| 1479 | Voltage-dependent T-type calcium channel alpha-1H subunit (Voltage-gated calcium channel alpha subunit Cav3.2) (Low-voltage-activated calcium channel alpha1 3.2 subunit) | O95180 |
| 1480 | Wiskott-Aldrich syndrome protein family member 4 (WASP-family protein member 4) | Q8IV90 |
| 1481 | ATP synthase coupling factor 6, mitochondrial precursor (EC 3.6.3.14) (ATPase subunit F6) | P18859 |
| 1482 | Proto-oncogene protein Wnt-3 precursor | P56703 |

TABLE 3-continued

SEQ ID NO, Parent Protein Identification and SwissProt Identification Number for full-length sequences 792-1513

| SEQ ID NO: | Parent Sequence Identification | Parent SwissProt Identification No. |
|---|---|---|
| 1483 | Amyloid beta A4 precursor protein-binding family A member 2 (Neuron-specific X11L protein) (Neuronal Munc18-1-interacting protein 2) (Mint-2) (Adapter protein X11beta) | Q99767 |
| 1484 | Zinc finger CCHC domain-containing protein 5 | Q8N8U3 |
| 1485 | Myeloid/lymphoid or mixed-lineage leukemia (Trithorax homolog, Drosophila) variant | Q59FF2 |
| 1486 | Zinc finger protein DZIP1 (DAZ-interacting protein 1/2) | Q86YF9 |
| 1487 | Hypothetical protein DKFZp761O1618 | Q69YS5 |
| 1488 | ATP-binding cassette sub-family F member 2 (Iron-inhibited ABC transporter 2) | Q9UG63 |
| 1489 | Ribosome biogenesis protein BOP1 (Block of proliferation 1 protein) | Q14137 |
| 1490 | CDNA FLJ13765 fis, clone PLACE4000128 | Q9H8C5 |
| 1491 | NDRG1 protein (N-myc downstream regulated gene 1 protein) | Q92597 |
| 1492 | Pre-mRNA splicing factor ATP-dependent RNA helicase PRP16 | Q92620 |
| 1493 | Nesprin 2 (Nuclear envelope spectrin repeat protein 2) | Q9NU50 |
| 1494 | Adenomatous polyposis coli | P25054 |
| 1495 | Ubiquitin conjugating enzyme E2 | P49459 |
| 1496 | B cell receptor-associated protein BAP31 (CDM protein) 6c6-AG | P5572 |
| 1497 | Topoisomerase II-alpha | P11388 |
| 1498 | Topoisomerase II beta | Q02880 |
| 1499 | Integrin beta8 subunit precursor | P26012 |
| 1500 | Replication Protein A | P27694 |
| 1501 | Abl Binding protein 3 | U31089 |
| 1502 | Cyclin I | Q14094 |
| 1503 | Cell Division Control Protein 2 (CDC2) | P06493 |
| 1504 | Septin 2 (NEDD5) | Q15019 |
| 1505 | STAT1 alpha/beta | P42224 |
| 1506 | LDL Receptor-related protein (LRP) | Q07954 |
| 1507 | TACE (ADAM17) | NP-068604 |
| 1508 | Junction plakoglobin (gamma catenin) | P14923 |
| 1509 | EDDR1 | Q08345 |
| 1510 | IP3 receptor type II | Q14571 |
| 1511 | Melanoma-associated antigen D2 (MAGE-D2 antigen) (MAGE-D) (Breast cancer-associated gene 1 protein) (BCG-1) (11B6) (Hepatocellular carcinoma-associated protein JCL-1) | Q9UNF1 |
| 1512 | Melanoma-associated antigen 4 (MAGE-4 antigen) (MAGE-X2) (MAGE-41) | P43358 |
| 1513 | HUMAN Retinoblastoma-like protein 2 (130 kDa retinoblastoma-associated protein) (PRB2) (P130) (RBR-2) | Q08999 |

SEQUENCE LISTING (1533 sequences)

SEQ ID NO: 1 - protein, 9 aa, Homo sapiens
AEAEFYRQV

SEQ ID NO: 2 - protein, 9 aa, homo sapiens
IYNGDMEKI

SEQ ID NO: 3 - protein, 9 aa, homo sapiens
KEFDGKSLV

SEQ ID NO: 4 - protein, 10 aa, Homo sapiens
HIPAGTLVQV

SEQ ID NO: 5 - protein, 9 aa, Homo sapiens
SLAEGLRTV

SEQ ID NO: 6 - protein, 9 aa, Homo sapiens
YLGDGPKLV

SEQ ID NO: 7 - protein, 9 aa, Homo sapiens
YLASLIRSV

SEQ ID NO: 8 - protein, 9 aa, Homo sapiens
FVDDYTVRV

SEQ ID NO: 9 - protein, 9 aa, Homo sapiens
KLLEPVLLL

SEQ ID NO: 10 - protein, 11 aa, Homo sapiens
KLIEVDDERKL

SEQ ID NO: 11 - protein, 9 aa, Homo sapiens
RLFEGNALL

SEQ ID NO: 12 - protein, 9 aa, Homo sapiens
TLYEAVREV

SEQ ID NO: 13 - protein, 9 aa, Homo sapiens
NMVAKVDEV

SEQ ID NO: 14 - protein, 9 aa, Homo sapiens
SLIKQIPRI

SEQ ID NO: 15 - protein, 11 aa, Homo sapiens
FLSEEGGHVAV

SEQ ID NO: 16 - protein, 9 aa, Homo sapiens
IETINFHEV

SEQ ID NO: 17 - protein, 9 aa, Homo sapiens
YLNDLIHSV

SEQ ID NO: 18 - protein, 10 aa, Homo sapiens
RVAPEEHPVL

SEQ ID NO: 19 - protein, 10 aa, Homo sapiens
DVLKIPVQLV

SEQ ID NO: 20 - protein, 9 aa, Homo sapiens
LSDFLKANV

SEQ ID NO: 21 - protein, 9 aa, Homo sapiens
DLCFEKVNV

SEQ ID NO: 22 - protein, 9 aa, Homo sapiens
KLHDINAQL

SEQ ID NO: 23 - protein, 10 aa, Homo sapiens
GNGAPDVFQT

SEQ ID NO: 24 - protein, 9 aa, Homo sapiens
IDAIRIPVL

SEQ ID NO: 25 - protein, 10 aa, Homo sapiens
FIASKGVKLV

SEQ ID NO: 26 - protein, 8 aa, Homo sapiens
HRPDLIDY

SEQ ID NO: 27 - protein, 11 aa, Homo sapiens
SPQGLELALPS

SEQ ID NO: 28 - protein, 11 aa, Homo sapiens
KIVKRPSLQFL

SEQ ID NO: 29 - protein, 10 aa, Homo sapiens
TLVTVSAAKT

SEQ ID NO: 30 - protein, 10 aa, Homo sapiens
KVLDGSPIEV

SEQ ID NO: 31 - protein, 10 aa, Homo sapiens
FLAEHPNVTL

SEQ ID NO: 32 - protein, 9 aa, Homo sapiens
NLVQDSLDL

SEQ ID NO: 33 - protein, 9 aa, Homo sapiens
ISENEKLQK

SEQ ID NO: 34 - protein, 10 aa, Homo sapiens
VLAARNPAKV

SEQ ID NO: 35 - protein, 10 aa, Homo sapiens
RYFDGNLEKL

SEQ ID NO: 36 - protein, 9 aa, Homo sapiens
TLADVLYHV

SEQ ID NO: 37 - protein, 11 aa, Homo sapiens
LPSPKPMKMKN

SEQ ID NO: 38 - protein, 9 aa, Homo sapiens
ISSMLVLFF

SEQ ID NO: 39 - protein, 10 aa, Homo sapiens
SPDEGALVRA

SEQ ID NO: 40 - protein, 9 aa, Homo sapiens
ILLTTLIPY

SEQ ID NO: 41 - protein, 9 aa, Homo sapiens
NLEQQETEP

SEQ ID NO: 42 - protein, 9 aa, Homo sapiens
RKVLYVMEL

SEQ ID NO: 43 - protein, 9 aa, Homo sapiens
EAIPARKLK

SEQ ID NO: 44 - protein, 9 aa, Homo sapiens
SLRLENITV

SEQ ID NO: 45 - protein, 9 aa, Homo sapiens
SYVLKKAQV

SEQ ID NO: 46 - protein, 9 aa, Homo sapiens
KLIHPKLEY

SEQ ID NO: 47 - protein, 9 aa, Homo sapiens
EFDQLDQEN

SEQ ID NO: 48 - protein, 10 aa, Homo sapiens
TVLLRLGDEL

SEQ ID NO: 49 - protein, 9 aa, Homo sapiens
LFEILIEQI

SEQ ID NO: 50 - protein, 10 aa, Homo sapiens
KLELDETGQE

SEQ ID NO: 51 - protein, 10 aa, Homo sapiens
LAIGAFTLLL

SEQ ID NO: 52 - protein, 9 aa, Homo sapiens
QILLDETLK

SEQ ID NO: 53 - protein, 9 aa, Homo sapiens
DECITNLLV

SEQ ID NO: 54 - protein, 11 aa, Homo sapiens
TVVSGSNVTLN

SEQ ID NO: 55 - protein, 9 aa, Homo sapiens
SLDERPVAV

SEQ ID NO: 56 - protein, 9 aa, Homo sapiens
MVDSQQKSP

SEQ ID NO: 57 - protein, 9 aa, Homo sapiens
SLLLLPEKN

SEQ ID NO: 58 - protein, 10 aa, Homo sapiens
VLCVSDIISL

SEQ ID NO: 59 - protein, 11 aa, Homo sapiens
FLPDPSALQNL

SEQ ID NO: 60 - protein, 9 aa, Homo sapiens
MLNEHDFEV

SEQ ID NO: 61 - protein, 9 aa, Homo sapiens
VNTDFSPYL

SEQ ID NO: 62 - protein, 10 aa, Homo sapiens
EFMLVYKFAR

SEQ ID NO: 63 - protein, 9 aa, Homo sapiens
TLWVDPYEV

SEQ ID NO: 64 - protein, 9 aa, Homo sapiens
FLDHIIASV

SEQ ID NO: 65 - protein, 9 aa, Homo sapiens
TLNDREYQL

SEQ ID NO: 66 - protein, 9 aa, Homo sapiens
VEVMVNDVN

SEQ ID NO: 67 - protein, 9 aa, Homo sapiens
LSIYLSIYL

SEQ ID NO: 68 - protein, 9 aa, Homo sapiens
SLSMVNHRL

SEQ ID NO: 69 - protein, 9 aa, Homo sapiens
RVDFPGFVR

SEQ ID NO: 70 - protein, 9 aa, Homo sapiens
MTDKAPPGV

SEQ ID NO: 71 - protein, 8 aa, Homo sapiens
WTNPQFKI

SEQ ID NO: 72 - protein, 11 aa, Homo sapiens
IMAQLPQEQKA

SEQ ID NO: 73 - protein, 9 aa, Homo sapiens
KIDPLEVEE

SEQ ID NO: 74 - protein, 9 aa, Homo sapiens
KLPEKWESV

SEQ ID NO: 75 - protein, 9 aa, Homo sapiens
LIEKEKVLN

SEQ ID NO: 76 - protein, 9 aa, Homo sapiens
FEVKEDQVK

SEQ ID NO: 77 - protein, 9 aa, Homo sapiens
DTEAEKSQV

SEQ ID NO: 78 - protein, 9 aa, Homo sapiens
FLKEHMDEV

SEQ ID NO: 79 - protein, 9 aa, Homo sapiens
KLLGELHTL

SEQ ID NO: 80 - protein, 9 aa, Homo sapiens
TLVEAFPTL

SEQ ID NO: 81 - protein, 10 aa, Homo sapiens
QSNKGFVVIN

SEQ ID NO: 82 - protein, 9 aa, Homo sapiens
LADGALIYR

SEQ ID NO: 83 - protein, 9 aa, Homo sapiens
GLGAEIEIR

SEQ ID NO: 84 - protein, 9 aa, Homo sapiens
GKLILLDKL

SEQ ID NO: 85 - protein, 8 aa, Homo sapiens
PQTICRKP

SEQ ID NO: 86 - protein, 8 aa, Homo sapiens
RSYYLNEI

SEQ ID NO: 87 - protein, 9 aa, Homo sapiens
TTITVSPFY

SEQ ID NO: 88 - protein, 10 aa, Homo sapiens
RLPDDDPTAV

SEQ ID NO: 89 - protein, 11 aa, Homo sapiens
LVAISTVSFSI

SEQ ID NO: 90 - protein, 9 aa, Homo sapiens
VLIDYQRNV

SEQ ID NO: 91 - protein, 9 aa, Homo sapiens
SILNEGGIK

SEQ ID NO: 92 - protein, 9 aa, Homo sapiens
YMADRLLGV

SEQ ID NO: 93 - protein, 9 aa, Homo sapiens
YLKDLIEEV

SEQ ID NO: 94 - protein, 9 aa, Homo sapiens
YLDIKGLLD

SEQ ID NO: 95 - protein, 9 aa, Homo sapiens
PCLSELHKA

SEQ ID NO: 96 - protein, 11 aa, Homo sapiens
TVLDFGVLASI

SEQ ID NO: 97 - protein, 9 aa, Homo sapiens
MPSETPQAE

SEQ ID NO: 98 - protein, 9 aa, Homo sapiens
FLLEALRKT

SEQ ID NO: 99 - protein, 9 aa, Homo sapiens
KMLETKWSL

SEQ ID NO: 100 - protein, 9 aa, Homo sapiens
QPLLKQSPW

SEQ ID NO: 101 - protein, 9 aa, Homo sapiens
YLLPAIVHI

SEQ ID NO: 102 - protein, 10 aa, Homo sapiens
KLLPGDIHQI

SEQ ID NO: 103 - protein, 10 aa, Homo sapiens
SLLKGDLKGV

SEQ ID NO: 104 - protein, 10 aa, Homo sapiens
NAEVLLVSEI

SEQ ID NO: 105 - protein, 9 aa, Homo sapiens
RLWGEPVNL

SEQ ID NO: 106 - protein, 10 aa, Homo sapiens
QLIDLSSPLI

SEQ ID NO: 107 - protein, 10 aa, Homo sapiens
YIDYTGAAYA

SEQ ID NO: 108 - protein, 11 aa, Homo sapiens
VIENKSDEKVI

SEQ ID NO: 109 - protein, 8 aa, Homo sapiens
PSPQLWTV

SEQ ID NO: 110 - protein, 12 aa, Homo sapiens
EGRGGLPAGLPV

SEQ ID NO: 111 - protein, 9 aa, Homo sapiens
NMYGKVVTV

SEQ ID NO: 112 - protein, 9 aa, Homo sapiens
RLYDGLFKV

SEQ ID NO: 113 - protein, 9 aa, Homo sapiens
QNFVDSKEV

SEQ ID NO: 114 - protein, 9 aa, Homo sapiens
ALIEKLVEL

SEQ ID NO: 115 - protein, 11 aa, Homo sapiens
VIEDDVNMAIR

SEQ ID NO: 116 - protein, 9 aa, Homo sapiens
SQDEIKQEV

SEQ ID NO: 117 - protein, 10 aa, Homo sapiens
HLNGSCHLLI

SEQ ID NO: 118 - protein, 9 aa, Homo sapiens
ALIDRMVNL

SEQ ID NO: 119 - protein, 10 aa, Homo sapiens
SQKIQEAVKA

SEQ ID NO: 120 - protein, 9 aa, Homo sapiens
LFDLVEEVQ

SEQ ID NO: 121 - protein, 9 aa, Homo sapiens
LLAALLLDP

SEQ ID NO: 122 - protein, 11 aa, Homo sapiens
FLDESRSTQYM

SEQ ID NO: 123 - protein, 9 aa, Homo sapiens
VLLGKVYVV

SEQ ID NO: 124 - protein, 9 aa, Homo sapiens
TIDELKEQV

SEQ ID NO: 125 - protein, 9 aa, Homo sapiens
NLAYENVKE

SEQ ID NO: 126 - protein, 9 aa, Homo sapiens
SEVEQYVKY

SEQ ID NO: 127 - protein, 8 aa, Homo sapiens
ETQLTYRR

SEQ ID NO: 128 - protein, 9 aa, Homo sapiens
IKDDLEDLI

SEQ ID NO: 129 - protein, 9 aa, Homo sapiens
QVLGKIERA

SEQ ID NO: 130 - protein, 9 aa, Homo sapiens
IQINLQRKM

SEQ ID NO: 131 - protein, 10 aa, Homo sapiens
KLIEKLDIKL

SEQ ID NO: 132 - protein, 9 aa, Homo sapiens
YLNEIKDSV

SEQ ID NO: 133 - protein, 10 aa, Homo sapiens
YLAEKYEWDV

SEQ ID NO: 134 - protein, 10 aa, Homo sapiens
VFEESQVAGT

SEQ ID NO: 135 - protein, 11 aa, Homo sapiens
DAQKEIVRAQK

SEQ ID NO: 136 - protein, 10 aa, Homo sapiens
DLEETVFTAS

SEQ ID NO: 137 - protein, 11 aa, Homo sapiens
AMLEGGVDGLL

SEQ ID NO: 138 - protein, 9 aa, Homo sapiens
RKADEKRIR

SEQ ID NO: 139 - protein, 9 aa, Homo sapiens
ALQEMVHQV

SEQ ID NO: 140 - protein, 10 aa, Homo sapiens
ILAINKPQNK

SEQ ID NO: 141 - protein, 10 aa, Homo sapiens
SMYGVDLHHA

SEQ ID NO: 142 - protein, 9 aa, Homo sapiens
SEDITRYYL

SEQ ID NO: 143 - protein, 9 aa, Homo sapiens
NQQEQEDLE

SEQ ID NO: 144 - protein, 9 aa, Homo sapiens
SKEEDPFNV

SEQ ID NO: 145 - protein, 9 aa, Homo sapiens
FLDKQGFYV

SEQ ID NO: 146 - protein, 10 aa, Homo sapiens
TGALIYAIHA

SEQ ID NO: 147 - protein, 10 aa, Homo sapiens
AVQVLMVLSL

SEQ ID NO: 148 - protein, 11 aa, Homo sapiens
TLKEVEELEQL

SEQ ID NO: 149 - protein, 9 aa, Homo sapiens
VLMTEDIKL

SEQ ID NO: 150 - protein, 9 aa, Homo sapiens
FEKKQKEMD

SEQ ID NO: 151 - protein, 11 aa, Homo sapiens
ELQALYALQAL

SEQ ID NO: 152 - protein, 9 aa, Homo sapiens
WSNKYDPPL

SEQ ID NO: 153 - protein, 9 aa, Homo sapiens
NLSDLIDLV

SEQ ID NO: 154 - protein, 9 aa, Homo sapiens
FLSHKLDIK

SEQ ID NO: 155 - protein, 9 aa, Homo sapiens
VEPALRKPP

SEQ ID NO: 156 - protein, 10 aa, Homo sapiens
QVVYSLPDSA

SEQ ID NO: 157 - protein, 9 aa, Homo sapiens
EKISSYQLK

SEQ ID NO: 158 - protein, 10 aa, Homo sapiens
FMDPQKMPYL

SEQ ID NO: 159 - protein, 10 aa, Homo sapiens
VTNRARASKD

SEQ ID NO: 160 - protein, 10 aa, Homo sapiens
SMNLTISAGP

SEQ ID NO: 161 - protein, 10 aa, Homo sapiens
VTYLQNGKGR

SEQ ID NO: 162 - protein, 10 aa, Homo sapiens
ELLKTARSSK

SEQ ID NO: 163 - protein, 9 aa, Homo sapiens
LKEYIQKLP

SEQ ID NO: 164 - protein, 9 aa, Homo sapiens
YLNKLLITR

SEQ ID NO: 165 - protein, 10 aa, Homo sapiens
IARPVGSSVR

SEQ ID NO: 166 - protein, 11 aa, Homo sapiens
QCPVEGDPPPL

SEQ ID NO: 167 - protein, 9 aa, Homo sapiens
TEDNVMKIA

SEQ ID NO: 168 - protein, 9 aa, Homo sapiens
YLLDVLERS

SEQ ID NO: 169 - protein, 9 aa, Homo sapiens
TASPDYLEI

SEQ ID NO: 170 - protein, 9 aa, Homo sapiens
TENNVMKIA

SEQ ID NO: 171 - protein, 11 aa, Homo sapiens
ETFKQIDMDND

SEQ ID NO: 172 - protein, 9 aa, Homo sapiens
GLLELIEEP

SEQ ID NO: 173 - protein, 9 aa, Homo sapiens
FVEEVIDNK

SEQ ID NO: 174 - protein, 9 aa, Homo sapiens
LQLYINKLD

SEQ ID NO: 175 - protein, 9 aa, Homo sapiens
EQSLETTKV

SEQ ID NO: 176 - protein, 10 aa, Homo sapiens
VFNDELPASI

SEQ ID NO: 177 - protein, 9 aa, Homo sapiens
SLFPGKLEV

SEQ ID NO: 178 - protein, 9 aa, Homo sapiens
QKKLVDTIE

SEQ ID NO: 179 - protein, 10 aa, Homo sapiens
DVGKDQEFTV

SEQ ID NO: 180 - protein, 11 aa, Homo sapiens
YLLKDKGEYTL

SEQ ID NO: 181 - protein, 9 aa, Homo sapiens
KTTDDIVKV

SEQ ID NO: 182 - protein, 8 aa, Homo sapiens
IEQERLER

SEQ ID NO: 183 - protein, 11 aa, Homo sapiens
KINSAPSSPIK

SEQ ID NO: 184 - protein, 9 aa, Homo sapiens
NNDICLDEV

SEQ ID NO: 185 - protein, 10 aa, Homo sapiens
VFAEVGCSPC

SEQ ID NO: 186 - protein, 9 aa, Homo sapiens
NIVETVLDL

SEQ ID NO: 187 - protein, 10 aa, Homo sapiens
IYIDGVQEVF

SEQ ID NO: 188 - protein, 11 aa, Homo sapiens
KIMTEKELLAV

SEQ ID NO: 189 - protein, 8 aa, Homo sapiens
VEAQEILR

SEQ ID NO: 190 - protein, 9 aa, Homo sapiens
MLLDFIQHI

SEQ ID NO: 191 - protein, 9 aa, Homo sapiens
SLLESVQKL

SEQ ID NO: 192 - protein, 9 aa, Homo sapiens
YLQPKLLGI

SEQ ID NO: 193 - protein, 10 aa, Homo sapiens
YLLVGTLFLL

SEQ ID NO: 194 - protein, 9 aa, Homo sapiens
MAAGDYPEA

SEQ ID NO: 195 - protein, 10 aa, Homo sapiens
LYLLVGTLFL

SEQ ID NO: 196 - protein, 9 aa, Homo sapiens
ALSDHHVYL

SEQ ID NO: 197 - protein, 9 aa, Homo sapiens
YLAPHVRTL

SEQ ID NO: 198 - protein, 9 aa, Homo sapiens
YLQNWSHVL

SEQ ID NO: 199 - protein, 10 aa, Homo sapiens
FAALMLLGLV

SEQ ID NO: 200 - protein, 9 aa, Homo sapiens
MINLAVFDL

SEQ ID NO: 201 - protein, 12 aa, Homo sapiens
EASALAVAPSAK

SEQ ID NO: 202 - protein, 9 aa, Homo sapiens
TFVLTIILV

SEQ ID NO: 203 - protein, 9 aa, Homo sapiens
FLLDFEEDL

SEQ ID NO: 204 - protein, 10 aa, Homo sapiens
FAMDSYGTSN

SEQ ID NO: 205 - protein, 10 aa, Homo sapiens
MELSEPIVEN

SEQ ID NO: 206 - protein, 9 aa, Homo sapiens
WLENALGKL

SEQ ID NO: 207 - protein, 11 aa, Homo sapiens
KILEHDDVSYL

SEQ ID NO: 208 - protein, 9 aa, Homo sapiens
SQQNTDNLV

SEQ ID NO: 209 - protein, 9 aa, Homo sapiens
SKLCEETPI

SEQ ID NO: 210 - protein, 9 aa, Homo sapiens
QLVVELKDI

SEQ ID NO: 211 - protein, 9 aa, Homo sapiens
VFDIFQFAK

SEQ ID NO: 212 - protein, 9 aa, Homo sapiens
NIANHFFTV

SEQ ID NO: 213 - protein, 9 aa, Homo sapiens
HLIHEVTKV

SEQ ID NO: 214 - protein, 10 aa, Homo sapiens
FLDPNNIPKA

SEQ ID NO: 215 - protein, 12 aa, Homo sapiens
KINEAVECLLSL

SEQ ID NO: 216 - protein, 9 aa, Homo sapiens
LLQTPKLLL

SEQ ID NO: 217 - protein, 9 aa, Homo sapiens
VLLYSVVVV

SEQ ID NO: 218 - protein, 9 aa, Homo sapiens
KFKQCKLLQ

SEQ ID NO: 219 - protein, 11 aa, Homo sapiens
DVLSTSSAISL

SEQ ID NO: 220 - protein, 9 aa, Homo sapiens
YIDDHSWTL

SEQ ID NO: 221 - protein, 9 aa, Homo sapiens
SLYEENNKL

SEQ ID NO: 222 - protein, 9 aa, Homo sapiens
KLLEVQILE

SEQ ID NO: 223 - protein, 9 aa, Homo sapiens
KPLLEQKEL

SEQ ID NO: 224 - protein, 10 aa, Homo sapiens
FPWELDPDWS

SEQ ID NO: 225 - protein, 10 aa, Homo sapiens
YLSAAINPIL

SEQ ID NO: 226 - protein, 10 aa, Homo sapiens
QLSLADVILL

SEQ ID NO: 227 - protein, 9 aa, Homo sapiens
QSFLVGNQL

SEQ ID NO: 228 - protein, 10 aa, Homo sapiens
LKNKTKEAAE

SEQ ID NO: 229 - protein, 10 aa, Homo sapiens
EDFHRKVYNI

SEQ ID NO: 230 - protein, 9 aa, Homo sapiens
YIDDVFHAL

SEQ ID NO: 231 - protein, 10 aa, Homo sapiens
EQLAELRQEF

SEQ ID NO: 232 - protein, 9 aa, Homo sapiens
GLLERVKEL

SEQ ID NO: 233 - protein, 9 aa, Homo sapiens
DAILRIVGE

SEQ ID NO: 234 - protein, 9 aa, Homo sapiens
RHKLVSDGQ

SEQ ID NO: 235 - protein, 9 aa, Homo sapiens
IQLVMKVIE

SEQ ID NO: 236 - protein, 9 aa, Homo sapiens
MTREELVKN

SEQ ID NO: 237 - protein, 9 aa, Homo sapiens
ALKDKIEKA

SEQ ID NO: 238 - protein, 9 aa, Homo sapiens
KIILRHLIE

SEQ ID NO: 239 - protein, 8 aa, Homo sapiens
TLGKLFWV

SEQ ID NO: 240 - protein, 11 aa, Homo sapiens
KGQGGAGGQFL

SEQ ID NO: 241 - protein, 9 aa, Homo sapiens
KEFLVVASV

SEQ ID NO: 242 - protein, 9 aa, Homo sapiens
KIAQKALDL

SEQ ID NO: 243 - protein, 10 aa, Homo sapiens
ITEPLPELQL

SEQ ID NO: 244 - protein, 9 aa, Homo sapiens
KLRKEKEEF

SEQ ID NO: 245 - protein, 9 aa, Homo sapiens
EDVFPNILN

SEQ ID NO: 246 - protein, 11 aa, Homo sapiens
IAVMLLEGGAN

SEQ ID NO: 247 - protein, 10 aa, Homo sapiens
VDLFPGTFEV

SEQ ID NO: 248 - protein, 10 aa, Homo sapiens
MVCGSPDIPL

SEQ ID NO: 249 - protein, 12 aa, Homo sapiens
DAPHSEGDMHLL

SEQ ID NO: 250 - protein, 9 aa, Homo sapiens
DTIEIITDR

SEQ ID NO: 251 - protein, 9 aa, Homo sapiens
RLFVGSIPK

SEQ ID NO: 252 - protein, 9 aa, Homo sapiens
FLSEYQHQP

SEQ ID NO: 253 - protein, 11 aa, Homo sapiens
LALMISMISAD

SEQ ID NO: 254 - protein, 9 aa, Homo sapiens
RMLPHAPGV

SEQ ID NO: 255 - protein, 10 aa, Homo sapiens
THNLLLNYGL

SEQ ID NO: 256 - protein, 10 aa, Homo sapiens
SPNMNAVISL

SEQ ID NO: 257 - protein, 9 aa, Homo sapiens
EFIDLLKKM

SEQ ID NO: 258 - protein, 11 aa, Homo sapiens
KMINHDSEKED

SEQ ID NO: 259 - protein, 10 aa, Homo sapiens
AVDEDRKMYL

SEQ ID NO: 260 - protein, 9 aa, Homo sapiens
LFELLEKEI

SEQ ID NO: 261 - protein, 9 aa, Homo sapiens
FISEFEHRV

SEQ ID NO: 262 - protein, 10 aa, Homo sapiens
AMFDHIPVGV

SEQ ID NO: 263 - protein, 8 aa, Homo sapiens
WSFCLACV

SEQ ID NO: 264 - protein, 9 aa, Homo sapiens
NLLFPIIYL

SEQ ID NO: 265 - protein, 9 aa, Homo sapiens
SLLENLEKI

SEQ ID NO: 266 - protein, 9 aa, Homo sapiens
ILDQKINEV

SEQ ID NO: 267 - protein, 9 aa, Homo sapiens
DQINIETKN

SEQ ID NO: 268 - protein, 9 aa, Homo sapiens
PFQNLLKEY

SEQ ID NO: 269 - protein, 10 aa, Homo sapiens
LELELENLEI

SEQ ID NO: 270 - protein, 11 aa, Homo sapiens
GLADASLLKKV

SEQ ID NO: 271 - protein, 10 aa, Homo sapiens
GQILEAAVSV

SEQ ID NO: 272 - protein, 9 aa, Homo sapiens
RVVSVSFRV

SEQ ID NO: 273 - protein, 9 aa, Homo sapiens
TQKRLDVYL

SEQ ID NO: 274 - protein, 9 aa, Homo sapiens
AMLTVLHEI

SEQ ID NO: 275 - protein, 9 aa, Homo sapiens
ARLAALVQR

SEQ ID NO: 276 - protein, 8 aa, Homo sapiens
FAVHFYRS

SEQ ID NO: 277 - protein, 9 aa, Homo sapiens
FNITYLDID

SEQ ID NO: 278 - protein, 9 aa, Homo sapiens
GLAKRVWSL

SEQ ID NO: 279 - protein, 9 aa, Homo sapiens
HLDATKLLL

SEQ ID NO: 280 - protein, 10 aa, Homo sapiens
IGSFHGVLSL

SEQ ID NO: 281 - protein, 9 aa, Homo sapiens
ILDLIDDAW

SEQ ID NO: 282 - protein, 9 aa, Homo sapiens
KLLEMVRED

SEQ ID NO: 283 - protein, 10 aa, Homo sapiens
LSYLPATVEP

SEQ ID NO: 284 - protein, 9 aa, Homo sapiens
QLAQFVHEV

SEQ ID NO: 285 - protein, 9 aa, Homo sapiens
SYDESDEEE

SEQ ID NO: 286 - protein, 9 aa, Homo sapiens
SYSDEFGPS

SEQ ID NO: 287 - protein, 12 aa, Homo sapiens
TVERADSSHLSI

SEQ ID NO: 288 - protein, 10 aa, Homo sapiens
VTENELAVIT

SEQ ID NO: 289 - protein, 9 aa, Homo sapiens
VTYLEDYSA

SEQ ID NO: 290 - protein, 9 aa, Homo sapiens
YLLEKTRVA

SEQ ID NO: 291 - protein, 9 aa, Homo sapiens
TLKILDLME

SEQ ID NO: 292 - protein, 9 aa, Homo sapiens
EDLIKELIK

SEQ ID NO: 293 - protein, 9 aa, Homo sapiens
LSLENLEKI

SEQ ID NO: 294 - protein, 10 aa, Homo sapiens
FLNKAADFIE

SEQ ID NO: 295 - protein, 10 aa, Homo sapiens
GLDIDGIYRV

SEQ ID NO: 296 - protein, 9 aa, Homo sapiens
QNNNLQTQI

SEQ ID NO: 297 - protein, 9 aa, Homo sapiens
FLDDVVHSL

SEQ ID NO: 298 - protein, 8 aa, Homo sapiens
NMVDLNDY

SEQ ID NO: 299 - protein, 10 aa, Homo sapiens
YLLKEDMAGI

SEQ ID NO: 300 - protein, 9 aa, Homo sapiens
KLFEKVKEV

SEQ ID NO: 301 - protein, 9 aa, Homo sapiens
TVMDEIHTV

SEQ ID NO: 302 - protein, 9 aa, Homo sapiens
KLISELQKL

SEQ ID NO: 303 - protein, 9 aa, Homo sapiens
KVIDEIYRV

SEQ ID NO: 304 - protein, 10 aa, Homo sapiens
SSLSDGLLLE

SEQ ID NO: 305 - protein, 9 aa, Homo sapiens
EEIVKVTFE

SEQ ID NO: 306 - protein, 9 aa, Homo sapiens
ELLENIIKN

SEQ ID NO: 307 - protein, 9 aa, Homo sapiens
ELLSLVQNL

SEQ ID NO: 308 - protein, 8 aa, Homo sapiens
PQQERDFY

SEQ ID NO: 309 - protein, 11 aa, Homo sapiens
GRGGKDPPLEP

SEQ ID NO: 310 - protein, 10 aa, Homo sapiens
LADISLHDPV

SEQ ID NO: 311 - protein, 10 aa, Homo sapiens
PSNMGIAIPL

SEQ ID NO: 312 - protein, 9 aa, Homo sapiens
FMMPQSLGV

SEQ ID NO: 313 - protein, 10 aa, Homo sapiens
IMVATAVVAI

SEQ ID NO: 314 - protein, 9 aa, Homo sapiens
MTKRYEALE

SEQ ID NO: 315 - protein, 9 aa, Homo sapiens
SLDAKEIYL

SEQ ID NO: 316 - protein, 9 aa, Homo sapiens
QLLDIKTRL

SEQ ID NO: 317 - protein, 9 aa, Homo sapiens
FLTDYLNDL

SEQ ID NO: 318 - protein, 10 aa, Homo sapiens
ANQGGFENGE

SEQ ID NO: 319 - protein, 10 aa, Homo sapiens
ILGLLLLHLE

SEQ ID NO: 320 - protein, 10 aa, Homo sapiens
VYQKEGVLAS

SEQ ID NO: 321 - protein, 9 aa, Homo sapiens
YLNDFTHEI

SEQ ID NO: 322 - protein, 9 aa, Homo sapiens
SPPLQGEIS

SEQ ID NO: 323 - protein, 9 aa, Homo sapiens
LFFEPVTTP

SEQ ID NO: 324 - protein, 8 aa, Homo sapiens
WISVPVVT

SEQ ID NO: 325 - protein, 10 aa, Homo sapiens
NMEIMPEGSL

SEQ ID NO: 326 - protein, 9 aa, Homo sapiens
QDQLSALQL

SEQ ID NO: 327 - protein, 9 aa, Homo sapiens
MEADPDLSR

SEQ ID NO: 328 - protein, 9 aa, Homo sapiens
LYLPATTPY

SEQ ID NO: 329 - protein, 9 aa, Homo sapiens
SEIEKNKKV

SEQ ID NO: 330 - protein, 9 aa, Homo sapiens
SLVQIVTTL

SEQ ID NO: 331 - protein, 9 aa, Homo sapiens
KILDIRKNV

SEQ ID NO: 332 - protein, 10 aa, Homo sapiens
QSLELLLLPV

SEQ ID NO: 333 - protein, 9 aa, Homo sapiens
ALLNNIIEI

SEQ ID NO: 334 - protein, 10 aa, Homo sapiens
FNQSSSLIIH

SEQ ID NO: 335 - protein, 10 aa, Homo sapiens
LSLSALPVSY

SEQ ID NO: 336 - protein, 9 aa, Homo sapiens
YLDLTPNQE

SEQ ID NO: 337 - protein, 9 aa, Homo sapiens
YLFERIKEL

SEQ ID NO: 338 - protein, 10 aa, Homo sapiens
FILDVLLPEA

SEQ ID NO: 339 - protein, 8 aa, Homo sapiens
EFIPEFEK

SEQ ID NO: 340 - protein, 11 aa, Homo sapiens
DVFPATPGSQN

SEQ ID NO: 341 - protein, 10 aa, Homo sapiens
FIFDVHVHEV

SEQ ID NO: 342 - protein, 9 aa, Homo sapiens
ILEVTNNLE

SEQ ID NO: 343 - protein, 9 aa, Homo sapiens
ILSKKDLPL

SEQ ID NO: 344 - protein, 9 aa, Homo sapiens
HEPPKAVDK

SEQ ID NO: 345 - protein, 9 aa, Homo sapiens
ILDDSHLLV

SEQ ID NO: 346 - protein, 9 aa, Homo sapiens
YLDNVVNKQ

SEQ ID NO: 347 - protein, 10 aa, Homo sapiens
KLLPYVGLLQ

SEQ ID NO: 348 - protein, 9 aa, Homo sapiens
QLKSLIQID

SEQ ID NO: 349 - protein, 9 aa, Homo sapiens
SLLNNPLSI

SEQ ID NO: 350 - protein, 10 aa, Homo sapiens
SSLSDALVLE

SEQ ID NO: 351 - protein, 9 aa, Homo sapiens
DELQQLFNL

SEQ ID NO: 352 - protein, 10 aa, Homo sapiens
QILSGRKPEL

SEQ ID NO: 353 - protein, 9 aa, Homo sapiens
KLVEVIEEV

SEQ ID NO: 354 - protein, 9 aa, Homo sapiens
QTLLKNPLY

SEQ ID NO: 355 - protein, 9 aa, Homo sapiens
SLLDDLHSA

SEQ ID NO: 356 - protein, 9 aa, Homo sapiens
HILDSSIYS

SEQ ID NO: 357 - protein, 10 aa, Homo sapiens
QSSPPPPPPS

SEQ ID NO: 358 - protein, 9 aa, Homo sapiens
LMCYAIMVT

SEQ ID NO: 359 - protein, 11 aa, Homo sapiens
FLSEEGGHVAV

SEQ ID NO: 360 - protein, 9 aa, Homo sapiens
SPDQELVLL

SEQ ID NO: 361 - protein, 9 aa, Homo sapiens
FLLVVLLKL

SEQ ID NO: 362 - protein, 9 aa, Homo sapiens
QIIEANYHS

SEQ ID NO: 363 - protein, 11 aa, Homo sapiens
ILIDKSGKLEL

SEQ ID NO: 364 - protein, 10 aa, Homo sapiens
TVMDSKIVQV

SEQ ID NO: 365 - protein, 9 aa, Homo sapiens
VMDSKIVQV

SEQ ID NO: 366 - protein, 11 aa, Homo sapiens
YQDPLDPTRSV

SEQ ID NO: 367 - protein, 8 aa, Homo sapiens
HEFLTPRL

SEQ ID NO: 368 - protein, 9 aa, Homo sapiens
GLFPWTPKL

SEQ ID NO: 369 - protein, 8 aa, Homo sapiens
CDVQRYNI

SEQ ID NO: 370 - protein, 9 aa, Homo sapiens
NMYGKVVTV

SEQ ID NO: 371 - protein, 9 aa, Homo sapiens
QNVQVNQKV

SEQ ID NO: 372 - protein, 9 aa, Homo sapiens
SLINQMTQV

SEQ ID NO: 373 - protein, 9 aa, Homo sapiens
NVTVAVPTV

SEQ ID NO: 374 - protein, 9 aa, Homo sapiens
LGLENLCHL

SEQ ID NO: 375 - protein, 9 aa, Homo sapiens
YYEKLHTYF

SEQ ID NO: 376 - protein, 9 aa, Homo sapiens
LLAALLLDP

SEQ ID NO: 377 - protein, 8 aa, Homo sapiens
RRDFGFPQ

SEQ ID NO: 378 - protein, 9 aa, Homo sapiens
SLLGFVYKL

SEQ ID NO: 379 - protein, 8 aa, Homo sapiens
LDRVFKNY

SEQ ID NO: 380 - protein, 9 aa, Homo sapiens
LMVDHVTEV

SEQ ID NO: 381 - protein, 9 aa, Homo sapiens
KMDQQEFSI

SEQ ID NO: 382 - protein, 9 aa, Homo sapiens
SLLLLPEEL

SEQ ID NO: 383 - protein, 9 aa, Homo sapiens
SQQNTDNLV

SEQ ID NO: 384 - protein, 9 aa, Homo sapiens
WLDETLAQV

SEQ ID NO: 385 - protein, 12 aa, Homo sapiens
VNLGGSKSISIS

SEQ ID NO: 386 - protein, 9 aa, Homo sapiens
ANYLDSMYI

SEQ ID NO: 387 - protein, 9 aa, Homo sapiens
HLWNSIHGL

SEQ ID NO: 388 - protein, 9 aa, Homo sapiens
SLADLMPRV

SEQ ID NO: 389 - protein, 10 aa, Homo sapiens
IDLSASLVLN

SEQ ID NO: 390 - protein, 9 aa, Homo sapiens
HLTYLNVYL

SEQ ID NO: 391 - protein, 10 aa, Homo sapiens
QLVACIESKL

SEQ ID NO: 392 - protein, 10 aa, Homo sapiens
EGKLVVQDIE

SEQ ID NO: 393 - protein, 11 aa, Homo sapiens
QALEAGAVVLI

SEQ ID NO: 394 - protein, 10 aa, Homo sapiens
VLSCSQALKI

SEQ ID NO: 395 - protein, 9 aa, Homo sapiens
LSIEGEQEL

SEQ ID NO: 396 - protein, 9 aa, Homo sapiens
EFQDLNQEV

SEQ ID NO: 397 - protein, 9 aa, Homo sapiens
RTKLTDIQI

SEQ ID NO: 398 - protein, 9 aa, Homo sapiens
RECKYDLPP

SEQ ID NO: 399 - protein, 9 aa, Homo sapiens
QLTKIQTEL

SEQ ID NO: 400 - protein, 10 aa, Homo sapiens
LVNAAQSVFV

SEQ ID NO: 401 - protein, 9 aa, Homo sapiens
VKAEDKARV

SEQ ID NO: 402 - protein, 9 aa, Homo sapiens
VLHDRIVSV

SEQ ID NO: 403 - protein, 11 aa, Homo sapiens
RNSIATLQGGR

SEQ ID NO: 404 - protein, 10 aa, Homo sapiens
TVNILIVDQN

SEQ ID NO: 405 - protein, 9 aa, Homo sapiens
YLFDLPLKV

SEQ ID NO: 406 - protein, 9 aa, Homo sapiens
NLAKDNEVL

SEQ ID NO: 407 - protein, 10 aa, Homo sapiens
SGDKLKLDQT

SEQ ID NO: 408 - protein, 9 aa, Homo sapiens
KLTDYQVTL

SEQ ID NO: 409 - protein, 9 aa, Homo sapiens
KIQEILTQV

SEQ ID NO: 410 - protein, 9 aa, Homo sapiens
YLDEQIKKV

SEQ ID NO: 411 - protein, 10 aa, Homo sapiens
SSIWEVDSLH

SEQ ID NO: 412 - protein, 9 aa, Homo sapiens
RLASYLDRV

SEQ ID NO: 413 - protein, 9 aa, Homo sapiens
ALLNIKVKL

SEQ ID NO: 414 - protein, 9 aa, Homo sapiens
FNIVKNKTE

SEQ ID NO: 415 - protein, 9 aa, Homo sapiens
KAITAPVSL

SEQ ID NO: 416 - protein, 9 aa, Homo sapiens
HEYLKAFKV

SEQ ID NO: 417 - protein, 9 aa, Homo sapiens
LKAFKVAYS

SEQ ID NO: 418 - protein, 9 aa, Homo sapiens
RLAVYIDRV

SEQ ID NO: 419 - protein, 10 aa, Homo sapiens
YLLGNSSPRT

SEQ ID NO: 420 - protein, 9 aa, Homo sapiens
EMKVSDLDR

SEQ ID NO: 421 - protein, 11 aa, Homo sapiens
VRLVDAGGVKL

SEQ ID NO: 422 - protein, 9 aa, Homo sapiens
KPETFEHLF

SEQ ID NO: 423 - protein, 9 aa, Homo sapiens
EITDDGNLK

SEQ ID NO: 424 - protein, 9 aa, Homo sapiens
ECHHRYAEL

SEQ ID NO: 425 - protein, 10 aa, Homo sapiens
PSTCPDGFKI

SEQ ID NO: 426 - protein, 9 aa, Homo sapiens
RKGIIDVNL

SEQ ID NO: 427 - protein, 9 aa, Homo sapiens
LIQERDVKK

SEQ ID NO: 428 - protein, 10 aa, Homo sapiens
LTLEQVVAIE

SEQ ID NO: 429 - protein, 10 aa, Homo sapiens
RDTPHSDFRG

SEQ ID NO: 430 - protein, 8 aa, Homo sapiens
HRVLLHLF

SEQ ID NO: 431 - protein, 9 aa, Homo sapiens
LLFDRPMHV

SEQ ID NO: 432 - protein, 9 aa, Homo sapiens
FLSELTQQL

SEQ ID NO: 433 - protein, 9 aa, Homo sapiens
SLLSHVEQL

SEQ ID NO: 434 - protein, 9 aa, Homo sapiens
KLILRLHKL

SEQ ID NO: 435 - protein, 9 aa, Homo sapiens
RLTHHPVYI

SEQ ID NO: 436 - protein, 9 aa, Homo sapiens
QDNLEKLLQ

SEQ ID NO: 437 - protein, 8 aa, Homo sapiens
MKRLLLLF

SEQ ID NO: 438 - protein, 9 aa, Homo sapiens
DPQDILEVK

SEQ ID NO: 439 - protein, 9 aa, Homo sapiens
FLFGEVHKA

SEQ ID NO: 440 - protein, 11 aa, Homo sapiens
KVIVLVNKVLL

SEQ ID NO: 441 - protein, 9 aa, Homo sapiens
QILSLEEKI

SEQ ID NO: 442 - protein, 9 aa, Homo sapiens
MLKDIIKEY

SEQ ID NO: 443 - protein, 9 aa, Homo sapiens
KTWGQYWQV

SEQ ID NO: 444 - protein, 10 aa, Homo sapiens
LLDGTATLRL

SEQ ID NO: 445 - protein, 9 aa, Homo sapiens
VLKEIVERV

SEQ ID NO: 446 - protein, 9 aa, Homo sapiens
SLLDEFYKL

SEQ ID NO: 447 - protein, 10 aa, Homo sapiens
TLNQNGYTLV

SEQ ID NO: 448 - protein, 9 aa, Homo sapiens
QMPKMNFAN

SEQ ID NO: 449 - protein, 10 aa, Homo sapiens
KLADFGVSGE

SEQ ID NO: 450 - protein, 9 aa, Homo sapiens
SIKDYEQAN

SEQ ID NO: 451 - protein, 9 aa, Homo sapiens
EDLMEDEDL

SEQ ID NO: 452 - protein, 10 aa, Homo sapiens
VLISKELISL

SEQ ID NO: 453 - protein, 9 aa, Homo sapiens
LIEKVQEAR

SEQ ID NO: 454 - protein, 9 aa, Homo sapiens
SRVRMKTPT

SEQ ID NO: 455 - protein, 10 aa, Homo sapiens
GLDDIKDLKV

SEQ ID NO: 456 - protein, 9 aa, Homo sapiens
VLAETLTQV

SEQ ID NO: 457 - protein, 9 aa, Homo sapiens
DTNADKQLS

SEQ ID NO: 458 - protein, 11 aa, Homo sapiens
GRWVCKDLPCP

SEQ ID NO: 459 - protein, 9 aa, Homo sapiens
FGNMQKINQ

SEQ ID NO: 460 - protein, 9 aa, Homo sapiens
FPNWTLAQV

SEQ ID NO: 461 - protein, 10 aa, Homo sapiens
ATPSSTPETV

SEQ ID NO: 462 - protein, 9 aa, Homo sapiens
FVNDVNLEN

SEQ ID NO: 463 - protein, 9 aa, Homo sapiens
SENKLILMK

SEQ ID NO: 464 - protein, 10 aa, Homo sapiens
TFCVQPGEKV

SEQ ID NO: 465 - protein, 9 aa, Homo sapiens
YLNDGLWHM

SEQ ID NO: 466 - protein, 9 aa, Homo sapiens
GTTLRNLEI

SEQ ID NO: 467 - protein, 11 aa, Homo sapiens
SPPTLNGAPSP

SEQ ID NO: 468 - protein, 10 aa, Homo sapiens
NEAAIKNVYL

SEQ ID NO: 469 - protein, 9 aa, Homo sapiens
FIDFGMDLQ

SEQ ID NO: 470 - protein, 9 aa, Homo sapiens
LLEAKVKEL

SEQ ID NO: 471 - protein, 9 aa, Homo sapiens
LLAEKVEQL

SEQ ID NO: 472 - protein, 10 aa, Homo sapiens
LANARGLGLQ

SEQ ID NO: 473 - protein, 10 aa, Homo sapiens
VNRIGQESLE

SEQ ID NO: 474 - protein, 9 aa, Homo sapiens
YLEIQGITR

SEQ ID NO: 475 - protein, 9 aa, Homo sapiens
EALENNKEL

SEQ ID NO: 476 - protein, 10 aa, Homo sapiens
NSMVVERQQL

SEQ ID NO: 477 - protein, 9 aa, Homo sapiens
HLLERVDQV

SEQ ID NO: 478 - protein, 9 aa, Homo sapiens
PERTQLLYL

SEQ ID NO: 479 - protein, 10 aa, Homo sapiens
NGGTCEDGIN

SEQ ID NO: 480 - protein, 10 aa, Homo sapiens
QSAADYLGAL

SEQ ID NO: 481 - protein, 11 aa, Homo sapiens
ALLVVLSPPAL

SEQ ID NO: 482 - protein, 9 aa, Homo sapiens
  misc_feature (5)..(5): Xaa can be any naturally occurring amino acid
LRLDXLFKL

SEQ ID NO: 483 - protein, 9 aa, Homo sapiens
WLIEDGKVV

SEQ ID NO: 484 - protein, 9 aa, Homo sapiens
SQPQEPENK

SEQ ID NO: 485 - protein, 9 aa, Homo sapiens
LLREKVEFL

SEQ ID NO: 486 - protein, 9 aa, Homo sapiens
YLDDVNEII

SEQ ID NO: 487 - protein, 9 aa, Homo sapiens
ALLDQLYLA

SEQ ID NO: 488 - protein, 9 aa, Homo sapiens
TLFDYEVRL

SEQ ID NO: 489 - protein, 9 aa, Homo sapiens
SILKVVINN

SEQ ID NO: 490 - protein, 10 aa, Homo sapiens
LLYGGDLHSA

SEQ ID NO: 491 - protein, 10 aa, Homo sapiens
KLAENIDAQL

SEQ ID NO: 492 - protein, 10 aa, Homo sapiens
SLLTDEEDVD

SEQ ID NO: 493 - protein, 9 aa, Homo sapiens
VDITQEPVL

SEQ ID NO: 494 - protein, 8 aa, Homo sapiens
QLEKKLME

SEQ ID NO: 495 - protein, 10 aa, Homo sapiens
GLDPLGYEIQ

SEQ ID NO: 496 - protein, 9 aa, Homo sapiens
ALLDRIVSV

SEQ ID NO: 497 - protein, 9 aa, Homo sapiens
KILDLETQL

SEQ ID NO: 498 - protein, 9 aa, Homo sapiens
VTWLKETEV

SEQ ID NO: 499 - protein, 10 aa, Homo sapiens
VDLPGVINTV

SEQ ID NO: 500 - protein, 10 aa, Homo sapiens
TITCLPATLV

SEQ ID NO: 501 - protein, 9 aa, Homo sapiens
LLGPRLVLA

SEQ ID NO: 502 - protein, 11 aa, Homo sapiens
LTTPDAAGVNQ

SEQ ID NO: 503 - protein, 9 aa, Homo sapiens
FLDGHDLQL

SEQ ID NO: 504 - protein, 10 aa, Homo sapiens
KTTEVLDASA

SEQ ID NO: 505 - protein, 12 aa, Homo sapiens
TSPTVPWTTSIF

SEQ ID NO: 506 - protein, 9 aa, Homo sapiens
WTITDTTEH

SEQ ID NO: 507 - protein, 9 aa, Homo sapiens
TITNLQYGE

SEQ ID NO: 508 - protein, 9 aa, Homo sapiens
ARLTFLNRG

SEQ ID NO: 509 - protein, 10 aa, Homo sapiens
KIDALSSEKL

SEQ ID NO: 510 - protein, 10 aa, Homo sapiens
LLAEAVLTYL

SEQ ID NO: 511 - protein, 10 aa, Homo sapiens
SLFEKGLKNV

SEQ ID NO: 512 - protein, 10 aa, Homo sapiens
LDTPSQPVNN

SEQ ID NO: 513 - protein, 10 aa, Homo sapiens
VLDELKNMKC

SEQ ID NO: 514 - protein, 11 aa, Homo sapiens
PQDYPDKKSLP

SEQ ID NO: 515 - protein, 9 aa, Homo sapiens
NLLPKLHIV

SEQ ID NO: 516 - protein, 12 aa, Homo sapiens
LAAAGGPGQGWA

SEQ ID NO: 517 - protein, 10 aa, Homo sapiens
GTPPPPGKPE

SEQ ID NO: 518 - protein, 10 aa, Homo sapiens
SQGAVGLAGV

SEQ ID NO: 519 - protein, 9 aa, Homo sapiens
ELKKINYQV

SEQ ID NO: 520 - protein, 9 aa, Homo sapiens
KLFQDLQDL

SEQ ID NO: 521 - protein, 9 aa, Homo sapiens
EAIVSHEKN

SEQ ID NO: 522 - protein, 10 aa, Homo sapiens
GLLPQVNTFV

SEQ ID NO: 523 - protein, 9 aa, Homo sapiens
KAYDVEREL

SEQ ID NO: 524 - protein, 9 aa, Homo sapiens
DVLESWLDF

SEQ ID NO: 525 - protein, 9 aa, Homo sapiens
TMLVLVIRG

SEQ ID NO: 526 - protein, 10 aa, Homo sapiens
DVAQLQALLQ

SEQ ID NO: 527 - protein, 9 aa, Homo sapiens
QIIEANYHS

SEQ ID NO: 528 - protein, 9 aa, Homo sapiens
YVTDVLYRV

SEQ ID NO: 529 - protein, 9 aa, Homo sapiens
FLDDEVIEL

SEQ ID NO: 530 - protein, 10 aa, Homo sapiens
VICILPNDDK

SEQ ID NO: 531 - protein, 9 aa, Homo sapiens
IQNSQLQLQ

SEQ ID NO: 532 - protein, 9 aa, Homo sapiens
FAYLLTYMA

SEQ ID NO: 533 - protein, 10 aa, Homo sapiens
GLIDSLVHYV

SEQ ID NO: 534 - protein, 8 aa, Homo sapiens
REDHPARP

SEQ ID NO: 535 - protein, 11 aa, Homo sapiens
FLLDPVKGERL

SEQ ID NO: 536 - protein, 9 aa, Homo sapiens
RGQNLDVVQ

SEQ ID NO: 537 - protein, 9 aa, Homo sapiens
SLTGHISTV

SEQ ID NO: 538 - protein, 9 aa, Homo sapiens
EPLRVPPDL

SEQ ID NO: 539 - protein, 10 aa, Homo sapiens
EIPVLNELPV

SEQ ID NO: 540 - protein, 9 aa, Homo sapiens
LYIPAMAFI

SEQ ID NO: 541 - protein, 9 aa, Homo sapiens
SLLQHLIGL

SEQ ID NO: 542 - protein, 9 aa, Homo sapiens
ISSMLVLFF

SEQ ID NO: 543 - protein, 10 aa, Homo sapiens
ENHSSQTDNI

SEQ ID NO: 544 - protein, 9 aa, Homo sapiens
ILMGVLKEV

SEQ ID NO: 545 - protein, 11 aa, Homo sapiens
VLFENTDSVHL

SEQ ID NO: 546 - protein, 8 aa, Homo sapiens
INMRIQDL

SEQ ID NO: 547 - protein, 9 aa, Homo sapiens
KTDKTLVLL

SEQ ID NO: 548 - protein, 9 aa, Homo sapiens
GLIEILKKV

SEQ ID NO: 549 - protein, 9 aa, Homo sapiens
NMVDIIHSV

SEQ ID NO: 550 - protein, 11 aa, Homo sapiens
ILDAGGHNVTI

SEQ ID NO: 551 - protein, 10 aa, Homo sapiens
YMNLEKPDFI

SEQ ID NO: 552 - protein, 9 aa, Homo sapiens
SLADIAQKL

SEQ ID NO: 553 - protein, 9 aa, Homo sapiens
QLVDIIEKV

SEQ ID NO: 554 - protein, 9 aa, Homo sapiens
SLLKVDQEV

SEQ ID NO: 555 - protein, 9 aa, Homo sapiens
QILRLLHIE

SEQ ID NO: 556 - protein, 10 aa, Homo sapiens
EMGGGENNLK

SEQ ID NO: 557 - protein, 9 aa, Homo sapiens
NLAEKLIGV

SEQ ID NO: 558 - protein, 10 aa, Homo sapiens
EKSVSVQTNL

SEQ ID NO: 559 - protein, 11 aa, Homo sapiens
GLLDSLTGILN

SEQ ID NO: 560 - protein, 11 aa, Homo sapiens
SLLPPDALVGL

SEQ ID NO: 561 - protein, 11 aa, Homo sapiens
LEEKNTLIQEL

SEQ ID NO: 562 - protein, 9 aa, Homo sapiens
LLSESNERL

SEQ ID NO: 563 - protein, 10 aa, Homo sapiens
LADLGSLESP

SEQ ID NO: 564 - protein, 9 aa, Homo sapiens
QLLKFQLNK

SEQ ID NO: 565 - protein, 10 aa, Homo sapiens
LLAEAVLTYL

SEQ ID NO: 566 - protein, 9 aa, Homo sapiens
QLLREPHLQ

SEQ ID NO: 567 - protein, 9 aa, Homo sapiens
TIPNLEQIE

SEQ ID NO: 568 - protein, 9 aa, Homo sapiens
KLWEAESKL

SEQ ID NO: 569 - protein, 9 aa, Homo sapiens
IFHLHELPE

SEQ ID NO: 570 - protein, 9 aa, Homo sapiens
KLFNDAIRL

SEQ ID NO: 571 - protein, 9 aa, Homo sapiens
FENQEVQAI

SEQ ID NO: 572 - protein, 9 aa, Homo sapiens
EYVEKFYRI

SEQ ID NO: 573 - protein, 8 aa, Homo sapiens
QIDEIRDK

SEQ ID NO: 574 - protein, 9 aa, Homo sapiens
FLHEKLESL

SEQ ID NO: 575 - protein, 9 aa, Homo sapiens
FELNNELKM

SEQ ID NO: 576 - protein, 9 aa, Homo sapiens
LLSNNNQAL

SEQ ID NO: 577 - protein, 10 aa, Homo sapiens
VLCGNKSDLE

SEQ ID NO: 578 - protein, 8 aa, Homo sapiens
LLMYDIAN

SEQ ID NO: 579 - protein, 12 aa, Homo sapiens
SQVNILSKIVSR

SEQ ID NO: 580 - protein, 9 aa, Homo sapiens
VMFNGKVYL

SEQ ID NO: 581 - protein, 9 aa, Homo sapiens
LEVEVIEAR

SEQ ID NO: 582 - protein, 8 aa, Homo sapiens
TLLRGIEW

SEQ ID NO: 583 - protein, 9 aa, Homo sapiens
PDFTELDLQ

SEQ ID NO: 584 - protein, 10 aa, Homo sapiens
DVLFALFSKL

SEQ ID NO: 585 - protein, 10 aa, Homo sapiens
RSGERKAVQA

SEQ ID NO: 586 - protein, 9 aa, Homo sapiens
GLNEEIARV

SEQ ID NO: 587 - protein, 9 aa, Homo sapiens
FLFQEPRSI

SEQ ID NO: 588 - protein, 11 aa, Homo sapiens
FLFQEPRSIVT

SEQ ID NO: 589 - protein, 9 aa, Homo sapiens
KEVDILNLP

SEQ ID NO: 590 - protein, 9 aa, Homo sapiens
YKLPMEDLK

SEQ ID NO: 591 - protein, 9 aa, Homo sapiens
TMVDRIEEV

SEQ ID NO: 592 - protein, 12 aa, Homo sapiens
VEGLLTLSDFDL

SEQ ID NO: 593 - protein, 9 aa, Homo sapiens
WMLDKLTGV

SEQ ID NO: 594 - protein, 9 aa, Homo sapiens
LLKHLLLLL

SEQ ID NO: 595 - protein, 9 aa, Homo sapiens
ALLSRLEQI

SEQ ID NO: 596 - protein, 9 aa, Homo sapiens
DVYEDELVP

SEQ ID NO: 597 - protein, 10 aa, Homo sapiens
VMLGGRNIKV

SEQ ID NO: 598 - protein, 10 aa, Homo sapiens
RLDELGGVYL

SEQ ID NO: 599 - protein, 9 aa, Homo sapiens
FEDKLIEDL

SEQ ID NO: 600 - protein, 9 aa, Homo sapiens
QLIDKVWQL

SEQ ID NO: 601 - protein, 9 aa, Homo sapiens
FLLEPQMKV

SEQ ID NO: 602 - protein, 10 aa, Homo sapiens
ILNEDGSPNL

SEQ ID NO: 603 - protein, 9 aa, Homo sapiens
LLAILILAL

SEQ ID NO: 604 - protein, 9 aa, Homo sapiens
SMNRGGYMP

SEQ ID NO: 605 - protein, 9 aa, Homo sapiens
EFIDGSLQM

SEQ ID NO: 606 - protein, 9 aa, Homo sapiens
ILVVYVIGL

SEQ ID NO: 607 - protein, 9 aa, Homo sapiens
TLSERLWLG

SEQ ID NO: 608 - protein, 9 aa, Homo sapiens
VLWDRTFSL

SEQ ID NO: 609 - protein, 9 aa, Homo sapiens
NVNFFTKPP

SEQ ID NO: 610 - protein, 9 aa, Homo sapiens
ETFSGVYKK

SEQ ID NO: 611 - protein, 9 aa, Homo sapiens
QLDDLKVEL

SEQ ID NO: 612 - protein, 8 aa, Homo sapiens
MEDLIHEI

SEQ ID NO: 613 - protein, 9 aa, Homo sapiens
QTDVDNDLV

SEQ ID NO: 614 - protein, 9 aa, Homo sapiens
LLIDPPRYI

SEQ ID NO: 615 - protein, 10 aa, Homo sapiens
PSIPTSAQHV

SEQ ID NO: 616 - protein, 9 aa, Homo sapiens
FLDEPTNHL

SEQ ID NO: 617 - protein, 11 aa, Homo sapiens
KMDDPDYWRTV

SEQ ID NO: 618 - protein, 9 aa, Homo sapiens
LANVQQVQI

SEQ ID NO: 619 - protein, 9 aa, Homo sapiens
SLFVVILVT

SEQ ID NO: 620 - protein, 9 aa, Homo sapiens
ARTIKIRNI

SEQ ID NO: 621 - protein, 10 aa, Homo sapiens
LVLTSGIVFV

SEQ ID NO: 622 - protein, 9 aa, Homo sapiens
VISFDKLKL

SEQ ID NO: 623 - protein, 8 aa, Homo sapiens
DLMELYKV

SEQ ID NO: 624 - protein, 10 aa, Homo sapiens
LQRRKPTGAF

SEQ ID NO: 625 - protein, 9 aa, Homo sapiens
KVNNEKFRT

SEQ ID NO: 626 - protein, 9 aa, Homo sapiens
SLDQPTQTV

SEQ ID NO: 627 - protein, 10 aa, Homo sapiens
SVTSEGIKAV

SEQ ID NO: 628 - protein, 10 aa, Homo sapiens
ISLSEPAKPG

SEQ ID NO: 629 - protein, 9 aa, Homo sapiens
ILDKKVEKV

SEQ ID NO: 630 - protein, 10 aa, Homo sapiens
KLSAEVESLK

SEQ ID NO: 631 - protein, 9 aa, Homo sapiens
VTWDAALYI

SEQ ID NO: 632 - protein, 9 aa, Homo sapiens
YLLPKDIKL

SEQ ID NO: 633 - protein, 11 aa, Homo sapiens
RLLEDGEDFNL

SEQ ID NO: 634 - protein, 9 aa, Homo sapiens
RVLPYPFTH

SEQ ID NO: 635 - protein, 8 aa, Homo sapiens
QNQERLER

SEQ ID NO: 636 - protein, 9 aa, Homo sapiens
QDNIKELEL

SEQ ID NO: 637 - protein, 9 aa, Homo sapiens
ILKQRDNEI

SEQ ID NO: 638 - protein, 10 aa, Homo sapiens
QNELDNVSTL

SEQ ID NO: 639 - protein, 10 aa, Homo sapiens
NIDLLDDGSN

SEQ ID NO: 640 - protein, 9 aa, Homo sapiens
VLQSNIQHV

SEQ ID NO: 641 - protein, 12 aa, Homo sapiens
VFFDIAVDGEPL

SEQ ID NO: 642 - protein, 9 aa, Homo sapiens
DFHFPKFSI

SEQ ID NO: 643 - protein, 10 aa, Homo sapiens
SYVNLPTIAL

SEQ ID NO: 644 - protein, 9 aa, Homo sapiens
SNLEHLGHE

SEQ ID NO: 645 - protein, 10 aa, Homo sapiens
LKLKLTAVEK

SEQ ID NO: 646 - protein, 9 aa, Homo sapiens
GLKGRVFEV

SEQ ID NO: 647 - protein, 10 aa, Homo sapiens
SLADLQNDEV

SEQ ID NO: 648 - protein, 9 aa, Homo sapiens
NNLPHLQVV

SEQ ID NO: 649 - protein, 9 aa, Homo sapiens
ISFGGSVQL

SEQ ID NO: 650 - protein, 8 aa, Homo sapiens
SILDQILQ

SEQ ID NO: 651 - protein, 9 aa, Homo sapiens
TLSDLRVYL

SEQ ID NO: 652 - protein, 8 aa, Homo sapiens
EAFVNSKN

SEQ ID NO: 653 - protein, 9 aa, Homo sapiens
VTWDAALYL

SEQ ID NO: 654 - protein, 9 aa, Homo sapiens
VLDDKLVFV

SEQ ID NO: 655 - protein, 9 aa, Homo sapiens
YLLDLHSYL

SEQ ID NO: 656 - protein, 9 aa, Homo sapiens
FLALAVIQL

SEQ ID NO: 657 - protein, 9 aa, Homo sapiens
TLAEVSTRL

SEQ ID NO: 658 - protein, 9 aa, Homo sapiens
VIEVYQEQI

SEQ ID NO: 659 - protein, 9 aa, Homo sapiens
RLWEEAVKA

SEQ ID NO: 660 - protein, 8 aa, Homo sapiens
SLKTLMLR

SEQ ID NO: 661 - protein, 8 aa, Homo sapiens
EIKKKFKL

SEQ ID NO: 662 - protein, 9 aa, Homo sapiens
VHKEMFIMV

SEQ ID NO: 663 - protein, 9 aa, Homo sapiens
VHKEMFIMV

SEQ ID NO: 664 - protein, 11 aa, Homo sapiens
LAGSEVALAGV

SEQ ID NO: 665 - protein, 9 aa, Homo sapiens
IPHDLFTEL

SEQ ID NO: 666 - protein, 12 aa, Homo sapiens
FLADPDTVNHLL

SEQ ID NO: 667 - protein, 9 aa, Homo sapiens
RVADRLYGV

SEQ ID NO: 668 - protein, 8 aa, Homo sapiens
HRPDLLDY

SEQ ID NO: 669 - protein, 9 aa, Homo sapiens
TLDENHPSI

SEQ ID NO: 670 - protein, 10 aa, Homo sapiens
TLAEIAKVEL

SEQ ID NO: 671 - protein, 9 aa, Homo sapiens
DVAVEAIRL

SEQ ID NO: 672 - protein, 9 aa, Homo sapiens
LMVDHVTEV

SEQ ID NO: 673 - protein, 9 aa, Homo sapiens
SLYEMVSRV

SEQ ID NO: 674 - protein, 9 aa, Homo sapiens
SINPKRAKL

SEQ ID NO: 675 - protein, 9 aa, Homo sapiens
NMYGKVVTV

SEQ ID NO: 676 - protein, 8 aa, Homo sapiens
SLFATEQL

SEQ ID NO: 677 - protein, 11 aa, Homo sapiens
RLQEGDKILSV

SEQ ID NO: 678 - protein, 9 aa, Homo sapiens
AMFDKKVQL

SEQ ID NO: 679 - protein, 9 aa, Homo sapiens
ALNELLQHV

SEQ ID NO: 680 - protein, 10 aa, Homo sapiens
RVVSMAALAM

SEQ ID NO: 681 - protein, 9 aa, Homo sapiens
GIIMQIIDV

SEQ ID NO: 682 - protein, 9 aa, Homo sapiens
IFNAIALFL

SEQ ID NO: 683 - protein, 9 aa, Homo sapiens
LEQGLFSKV

SEQ ID NO: 684 - protein, 10 aa, Homo sapiens
KFMHMGKRQK

SEQ ID NO: 685 - protein, 8 aa, Homo sapiens
SNFGNEKL

SEQ ID NO: 686 - protein, 9 aa, Homo sapiens
FLLDKKIGV

SEQ ID NO: 687 - protein, 10 aa, Homo sapiens
RSLAASNPIL

SEQ ID NO: 688 - protein, 9 aa, Homo sapiens
EMESLTGHQ

SEQ ID NO: 689 - protein, 9 aa, Homo sapiens
LDFQEELEV

SEQ ID NO: 690 - protein, 11 aa, Homo sapiens
SPNSEGDAGDL

SEQ ID NO: 691 - protein, 11 aa, Homo sapiens
LVYLNESSVLH

SEQ ID NO: 692 - protein, 10 aa, Homo sapiens
VAGIKVNQVK

SEQ ID NO: 693 - protein, 9 aa, Homo sapiens
ILYELQVEL

SEQ ID NO: 694 - protein, 9 aa, Homo sapiens
EVLDELYRV

SEQ ID NO: 695 - protein, 10 aa, Homo sapiens
TNIEDGVFET

SEQ ID NO: 696 - protein, 9 aa, Homo sapiens
EIRKNEGQI

SEQ ID NO: 697 - protein, 9 aa, Homo sapiens
IAAKILSYN

SEQ ID NO: 698 - protein, 9 aa, Homo sapiens
LYGRHFNYL

SEQ ID NO: 699 - protein, 9 aa, Homo sapiens
NLFNKYPAL

SEQ ID NO: 700 - protein, 9 aa, Homo sapiens
YLDEIVKEV

SEQ ID NO: 701 - protein, 10 aa, Homo sapiens
ENHSSQTDNI

SEQ ID NO: 702 - protein, 8 aa, Homo sapiens
RTHMLSSL

SEQ ID NO: 703 - protein, 9 aa, Homo sapiens
QATIAPVTV

SEQ ID NO: 704 - protein, 9 aa, Homo sapiens
NLFRAPIYL

SEQ ID NO: 705 - protein, 11 aa, Homo sapiens
KLEEEQEKNQL

SEQ ID NO: 706 - protein, 9 aa, Homo sapiens
LNVDTPFPL

SEQ ID NO: 707 - protein, 9 aa, Homo sapiens
ILYELKVEL

SEQ ID NO: 708 - protein, 10 aa, Homo sapiens
KFMHMGKRQK

SEQ ID NO: 709 - protein, 10 aa, Homo sapiens
HSDEGGVASL

SEQ ID NO: 710 - protein, 10 aa, Homo sapiens
AMLTGELKKA

SEQ ID NO: 711 - protein, 9 aa, Homo sapiens
VFPTHVFPT

SEQ ID NO: 712 - protein, 11 aa, Homo sapiens
KELAELRESTS

SEQ ID NO: 713 - protein, 9 aa, Homo sapiens
LTDKEGWIL

SEQ ID NO: 714 - protein, 9 aa, Homo sapiens
VVTYKNENI

SEQ ID NO: 715 - protein, 9 aa, Homo sapiens
TVAEGLIED

SEQ ID NO: 716 - protein, 9 aa, Homo sapiens
NEKIKKDEL

SEQ ID NO: 717 - protein, 9 aa, Homo sapiens
ILDESHERV

SEQ ID NO: 718 - protein, 9 aa, Homo sapiens
NLYSDYILN

SEQ ID NO: 719 - protein, 8 aa, Homo sapiens
RYVNGHAK

SEQ ID NO: 720 - protein, 10 aa, Homo sapiens
KLLDLELAPS

SEQ ID NO: 721 - protein, 9 aa, Homo sapiens
YLYDLNHTL

SEQ ID NO: 722 - protein, 8 aa, Homo sapiens
FFFWLMEL

SEQ ID NO: 723 - protein, 10 aa, Homo sapiens
ELSSLKETHI

SEQ ID NO: 724 - protein, 9 aa, Homo sapiens
KLGSVPVTV

SEQ ID NO: 725 - protein, 9 aa, Homo sapiens
ALWERIEGV

SEQ ID NO: 726 - protein, 8 aa, Homo sapiens
VKAQEILR

SEQ ID NO: 727 - protein, 10 aa, Homo sapiens
ANVDAIVVSV

SEQ ID NO: 728 - protein, 10 aa, Homo sapiens
CKDGEDSIIR

SEQ ID NO: 729 - protein, 9 aa, Homo sapiens
DNTKKSDKT

SEQ ID NO: 730 - protein, 9 aa, Homo sapiens
EFLGDSIMQ

SEQ ID NO: 731 - protein, 9 aa, Homo sapiens
EFLQEGLEK

SEQ ID NO: 732 - protein, 9 aa, Homo sapiens
FLLKCLEQV

SEQ ID NO: 733 - protein, 11 aa, Homo sapiens
FLTDSNNIKEV

SEQ ID NO: 734 - protein, 10 aa, Homo sapiens
GGVQELLNQQ

SEQ ID NO: 735 - protein, 9 aa, Homo sapiens
GKPRRKSNL

SEQ ID NO: 736 - protein, 9 aa, Homo sapiens
HIKEELMHG

SEQ ID NO: 737 - protein, 8 aa, Homo sapiens
HIPFFLHN

SEQ ID NO: 738 - protein, 9 aa, Homo sapiens
ILEKKVEKV

SEQ ID NO: 739 - protein, 9 aa, Homo sapiens
ILMEHIHKL

SEQ ID NO: 740 - protein, 12 aa, Homo sapiens
KASQLGIFISKV

SEQ ID NO: 741 - protein, 9 aa, Homo sapiens
KILEVMHTK

SEQ ID NO: 742 - protein, 10 aa, Homo sapiens
LAVGTSPVLA

SEQ ID NO: 743 - protein, 9 aa, Homo sapiens
LLAEEARKL

SEQ ID NO: 744 - protein, 9 aa, Homo sapiens
LLGICFCIA

SEQ ID NO: 745 - protein, 10 aa, Homo sapiens
LMAEMGVHSV

SEQ ID NO: 746 - protein, 9 aa, Homo sapiens
ISRLENITV

SEQ ID NO: 747 - protein, 11 aa, Homo sapiens
MISLPGPLVTN

SEQ ID NO: 748 - protein, 9 aa, Homo sapiens
MLLDVMHTV

SEQ ID NO: 749 - protein, 9 aa, Homo sapiens
NVMNLIDFV

SEQ ID NO: 750 - protein, 9 aa, Homo sapiens
NVTMKDNKI

SEQ ID NO: 751 - protein, 9 aa, Homo sapiens
PRSNIDVNI

SEQ ID NO: 752 - protein, 9 aa, Homo sapiens
PSAQPLLSL

SEQ ID NO: 753 - protein, 9 aa, Homo sapiens
QLKESKLKI

SEQ ID NO: 754 - protein, 9 aa, Homo sapiens
RDAPHLPDG

SEQ ID NO: 755 - protein, 11 aa, Homo sapiens
RLPPEGILHNV

SEQ ID NO: 756 - protein, 10 aa, Homo sapiens
SEGAEYDDQT

SEQ ID NO: 757 - protein, 9 aa, Homo sapiens
SLFERLVKV

SEQ ID NO: 758 - protein, 9 aa, Homo sapiens
SLLDKIIGA

SEQ ID NO: 759 - protein, 9 aa, Homo sapiens
SMMDVDHQI

SEQ ID NO: 760 - protein, 9 aa, Homo sapiens
TLDEKIEKV

SEQ ID NO: 761 - protein, 10 aa, Homo sapiens
TLLEDGTFKV

SEQ ID NO: 762 - protein, 9 aa, Homo sapiens
TVLKTKFSS

SEQ ID NO: 763 - protein, 11 aa, Homo sapiens
VIFEDVGRQVL

SEQ ID NO: 764 - protein, 9 aa, Homo sapiens
YILDINPLL

SEQ ID NO: 765 - protein, 11 aa, Homo sapiens
YKTFSTSMMLL

SEQ ID NO: 766 - protein, 11 aa, Homo sapiens
RLPPEGILHNV

SEQ ID NO: 767 - protein, 9 aa, Homo sapiens
LLGPRVLSP

SEQ ID NO: 768 - protein, 9 aa, Homo sapiens
FIILLVTYI

SEQ ID NO: 769 - protein, 8 aa, Homo sapiens
FYDIETLK

SEQ ID NO: 770 - protein, 11 aa, Homo sapiens
WMAPESIFDKI

SEQ ID NO: 771 - protein, 9 aa, Homo sapiens
LLDQQNPDE

SEQ ID NO: 772 - protein, 11 aa, Homo sapiens
VMFKKIKSFEV

SEQ ID NO: 773 - protein, 12 aa, Homo sapiens
KLLEGEESRISL

SEQ ID NO: 774 - protein, 12 aa, Homo sapiens
KLLEGEESRISL

SEQ ID NO: 775 - protein, 9 aa, Homo sapiens
RILGAVAKV

SEQ ID NO: 776 - protein, 9 aa, Homo sapiens
SLSMVNHRL

SEQ ID NO: 777 - protein, 12 aa, Homo sapiens
VGQADGGLSVLR

SEQ ID NO: 778 - protein, 9 aa, Homo sapiens
DVATILSRR

SEQ ID NO: 779 - protein, 11 aa, Homo sapiens
PKFEVIEKPQA

SEQ ID NO: 780 - protein, 11 aa, Homo sapiens
NCTTIDDSLAI

SEQ ID NO: 781 - protein, 9 aa, Homo sapiens
ILPTVILAN

SEQ ID NO: 782 - protein, 10 aa, Homo sapiens
EFLELSAAQE

SEQ ID NO: 783 - protein, 9 aa, Homo sapiens
SLTDKVQEA

SEQ ID NO: 784 - protein, 10 aa, Homo sapiens
SKNSALEYQL

SEQ ID NO: 785 - protein, 9 aa, Homo sapiens
LQDVEEVEI

SEQ ID NO: 786 - protein, 9 aa, Homo sapiens
FLDEPTNHL

SEQ ID NO: 787 - protein, 11 aa, Homo sapiens
KMDDPDYWRTV

SEQ ID NO: 788 - protein, 9 aa, Homo sapiens
LANVQQVQI

SEQ ID NO: 789 - protein, 9 aa, Homo sapiens
KLDPTKTTL

SEQ ID NO: 790 - protein, 9 aa, Homo sapiens
HLTYLNVYL

SEQ ID NO: 791 - protein, 9 aa, Homo sapiens
ALWDKLFNL

SEQ ID NO: 792 - protein, 1755 aa, Homo sapiens
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGPHIPSSLASPMRLSTPSASPAIPPLVHCADKSLPWKMGVSPGNPVDSHAYPHIQNSKQPRVPSAKAVTSGLPGDTALLLPPSPRPSPRVHLPTQPAADTYSEFHKHYARISTSPSVALSKPYMTVSSEFPAARLSNGKYPKAPEGGEGAQPVPGHARKTAVQDRKDGSSPPLLEKQTVTKDVTDKPLDLSSKVVDVDASKADHMKKMAPTVLVHSRAGSGLVLSGSEIPKETLSPPGNGCAIYRSEIISTAPSSWVVPGPSPNEENNGKSMSLKNKALDWAIPQQRSSSCPRMGGTDAVITNVSGSVSSAGRPASASPAPNANADGTKTSRSSVETTPSVIQHVGQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQMEGLQEDSILCLPAAYCERAMMRFSELEMKEREGGHPATKDSEMCKFSPADWERLKGNQDKKPKSVTLEEAIAEQNESERCEYSVGNKHRDPFEAPEDKDLPVEKYFVERQPVSEPPADQVASDMPHSPTLRVDRKRKVSGDSSHTETTAEEVPEDPLLKAKRRRVSKDDWPEREMTNSSSNHLEDPHYSELTNLKVCIELTGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQGPRNWLLLSDVLKKLKMSSRIFRCNFPNVEIVTIAEAEFYRQVSASLLFSCSKDLEAFNPESKELLDLVEFTNEIQTLLGSSVEWLHPSDLASDNYW

SEQ ID NO: 793 - protein, 194 aa, Homo sapiens
MSQNGAPGMQEESLQGSWVELHFSNNGNGGSVPASVSIYNGDMEKILLDAQHESGRSSSKSSHCDSPPRSQTPQDTNRASETDTHSIGEKNSSQSEEDDIERRKEVESILKKNSDWIWDWSSRPENIPPKEFLFKHPKRTATLSMRNTSVMKKGGIFSAEFLKVFLPSLLLSHLLAIGLGIYIGRRLTTSTSTF

SEQ ID NO: 794 - protein, 723 aa, Homo sapiens
PEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 795 - protein, 503 aa, Homo sapiens
MALRAKAEVCVAAPWLSLQRARALGTRAARAPRTVLPFEAMPQHPGNRWLRLLQIWREQGYEHLHLEMHQTFQELGPIFRYNLGGPRMVCVMLPEDVEKLQQVDSLHPCRMILEPWVAYRQHRGHKCGVFLLNGPEWRFNRLRLNPDVLSPKAVQRFLPMVDAVARDFSQALKKKVLQNARGSLTLDVQPSIFHYTIEASNLALFGERLGLVGHSPSSASLNFLHALEVMFKSTVQLMFMPRSLSRWISPKVWKEHFEAWDCIFQYGDNCIQKIYQELAFNRPQHYTGIVAELLLKAELSLEAIKANSMELTAGSVDTTAFPLLMTLFELARNPDVQQILRQESLAAAASISEHPQKATTELPLLRAALKETLRLYPVGLFLERVVSSDLVLQNYHIPAGTLVQVFLYSLGRNAALFPRPERYNPQRWLDIRGSGRNFHHVPFGFGMRQCLGRRLAEAEMLLLLHHVLKHFLVETLTQEDIKMVYSFILRPGTSPLLTFRAIN

SEQ ID NO: 796 - protein, 1087 aa, Homo sapiens [sequence omitted]

SEQ ID NO: 797 - protein, 440 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 798 - protein, 324 aa, Homo sapiens
MPELAVQKVVVHPLVLLSVVDHFNRIGKVGNQKRVVGVLLGSWQKKVLDVSNSFAVPFDEDDKDDSVWFLDHDYLENMYGMFKKVNARERIVGWYHTGPKLHKNDIAINELMKRYCPNSVLVIIDVKPKDLGLPTEAYISVEEVHDDGTPTSKTFEHVTSEIGAEEAEEVGVEHLLRDIKDTTVGTLSQRITNQVHGLKGLNSKLLDIRSYLEKVATGKLPINHQIIYQLQDVFNLLPDVSLQEFVKAFYLKTNDQMVVVYLASLIRSVVALHNLINNKIANRDAEKKEGQEKEESKKDRKEDKEKDKDKEKSDVKKEEKKEKK

SEQ ID NO: 799 - protein, 310 aa, Homo sapiens
MDRLLRLGGGMPGLGQGPPTDAPAVDTAEQVYISSLALLKMLKHGRAGVPMEVMGLMLGEFVDDYTVRVIDVFAMPQSGTGVSVEAVDPVFQAKMLDMLKQTGRPEMVVGWYHSHPGFGCWLSGVDINTQQSFEALSERAVAVVVDPIQSVKGKVVIDAFRLINANMMVLGHEPRQTTSNLGHLNKPSIQALIHGLNRHYYSITINYRKNELEQKMLLNLHKKSWMEGLTLQDYSEHCKHNESVVKEMLELAKNYNKAVEEEDKMTPEQLAIKNVGKQDPKRHLEEHVDVLMTSNIVQCLAAMLDTVVFK

SEQ ID NO: 800 - protein, 145 aa, Homo sapiens [sequence omitted]

SEQ ID NO: 801 - protein, 249 aa, Homo sapiens
MKLNISFPATGCQKLIEVDDERKLRTFYEKRMATEVAADALGEEWKGYVVRISGGNDKQGFPMKQGVLTHGRVRLLLSKGHSCYRPRRTGERKRKSVRGCIVDANLSVLNLVIVKKGEKDIPGLTDTTVPRRLGPKRASRIRKLFNLSKEDDVRQYVVRKPLNKEGKKPRTKAPKIQRLVTPRVLQHKRRRIALKKQRTKKNKEEAAEYAKLLAKRMKEAKEKRQEQIAKRRRLSSLRASTSKSESSQK

SEQ ID NO: 802 - protein, 193 aa, Homo sapiens
PVARSWVCRKTYVTPRRPFEKSRLDQELKLIGEYGLRNKREVWRVKFTLAKIRKAARELLTLDEKDPRRLFEGNALLRRLVRIGVLDEGKMKLDYILGLKIEDFLERRLQTQVFKLGLAKSIHHARVLIRQRHIRVRKQVVNIPSFIVRLDSQKHIDFSLRSPYGGGRPGRVKRKNAKKGQGGAGAGDDEEED

SEQ ID NO: 803 - protein, 216 aa, Homo sapiens
SSKVSRDTLYEAVREVLHGNQRKRRKFLETVELQISLKNYDPQKDKRFSGTVRLKSTPRPKFSVCVLGDQQHCDEAKAVDIPHMDIEALKKLNKNKKLVKKLAKKYDAFLASESLIKQIPRILGPGLNKAGKFPSLLTHNENMVAKVDEVKSTIKFQMKKVLCLAVAVGHVKMTDDELVYNIHLAVNFLVSLLKKNWQNVRALYIKSTMGKPQRLY

SEQ ID NO: 804 - protein, 468 aa, Homo sapiens
ASPRELTQNPLKKIWMPYSNGRPALHACQRGVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKVLNEIDAGVCEEMTYEEIQDNYPLEFALRDQDKYRYRYPKGESYEDLVQRLEPVIMELERQENVLVICHQAVMRCLLAYFLDKAAEQLPYLKCPLHTVLKLTPVAYGCKVESIFLNVAAVNTHRDRPQNVDISRPPEEALVTVPAHQ

SEQ ID NO: 805 - protein, 684 aa, Homo sapiens
MSAIPAEESDQLLIRPLGAGQEVGRSCIILEFKGRKIMLDCGIHPGLEGMDALPYIDLIDPAEIDLLLISHFHLDHCGALPWFLQKTSFKGRTFMTHATKAIYRWLLSDYVKVSNISADDMLYTETDLEESMDKIETINFHEVKEVAGIKFWCYHAGHVLGAAMFMIEIAGVKLLYTGDFSRQEDRHLMAAEIPNIKPDILIIESTYGTHIHEKREEREARFCNTVHDIVNRGGRGLIPVFALGRAQELLLILDEYWQNHPELHDIPIYYASSLAKKCMAVYQTYVNAMNDKIRKQININNPFVFKHISNLKSMDHFDDIGPSVVMASPGMMQSGLSRELFESWCTDKRNGVIIAGYCVEGTLAKHIMSEPEEITTMSGQKLPLKMSVDYISFSAHTDYQQTSEFIRALKPPHVILVHGEQNEMARLKAALIREYEDNDEVHIEVHNPRNTEAVTLNFRGEKLAKVMGFLADKKPEQGQRVSGILVKRNFNYHILSPCDLSNYTDLAMSTVKQTQAIPYTGPFNLLCYQLQKLTGDVEELEIQEKPALKVFKNITVIQEPGMVVLEWLANPSNDMYADTVTTVILEVQSNPKIRKGAVQKVSKKLEMHVYSKRLEIMLQDIFGEDCVSVKDDSILSVTVDGKTANLNLETRTVECEEGSEDDESLREMVELAAQRLYEALTPVH

SEQ ID NO: 806 - protein, 662 aa, Homo sapiens
MRGAGPSPRQSPRTLRPDPGPAMSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTVKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKVFLPGFLSSNLYYKYLNDLIHSVRGDEFLGGNVSLTAPGSVGPPDESHPGSSDSSASQSSVKKASIKILKNFDEAIIVDAASLDPESLYQRTYAGKMTFGRVSDLGQFIRESEPEPDVRKSKGSMFSQAMKKWVQGNTDEAQEELAWKIAKMIVSDIMQQAQYDQPLEKSTKL

SEQ ID NO: 807 - protein, 375 aa, Homo sapiens
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 808 - protein, 1445 aa, Homo sapiens [sequence omitted]

SEQ ID NO: 809 - protein, 513 aa, Homo sapiens
MGAAAKLAFAVFLISCSSGAILGRSETQECLFFNANWEKDRTNQTGVEPCYGDKDKRRHCFATWKNISGSIEIVKQGCWLDDINCYDRTDCVEKKDSPEVYFCCCEGNMCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKQSWQNEYEVYSLPGMKHENILQFIGAEKRGTSVDVDLWLITAFHEKGSLSDFLKANVVSWNELCHIAETMARGLAYLHEDIPGLKDGHKPAISHRDIKSKNVLLKNNLTACIADFGLALKFEAGKSAGDTHGQVGTRRYMAPEVLEGAINFQRDAFLRIDMYAMGLVLWELASRCTAADGPVDEYMLPFEEEIGQHPSLEDMQEVVVHKKKRPVLRDYWQKHAGMAMLCETIEECWDHDAEARLSAGCVGERITQMQRLTNIITTEDIVTVVTMVTNVDFPPKESSL

SEQ ID NO: 810 - protein, 488 aa, Homo sapiens
DCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKRVWKTCNLKTGDQFQSQ

SEQ ID NO: 811 - protein, 949 aa, Homo sapiens
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLMGDEPEGIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPAAPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTDLELSLKCRAPEVSQHVYQAYETILKN

SEQ ID NO: 812 - protein, 703 aa, Homo sapiens
MSARATRPRSRRGRHAPPGELDPVAESSEEVEAASGSSKPSFAPPPVSSGLEQLGPMEEVSGQGLGSRTDKKMDGGSGRELASAPEVPHKPAVEAHQAPEAALQYKETVPPGNGAPDVFQTLQHTLSSLEAAAAAWRHQPPSHSGPMEFEGTSEGGAGSLGKQEGAGSCQREAARLAERNAWLRLALSSREDELVRTQASLEAIRAEKETLQKEVQELQDSLLRLEPCPHLSHNQAGGSGSGSSSSEADREPWETQDSFSLAHPLLRRLRSHSSTQILGSLPNQPLSPEMHIMEAQMEQLRGSIEKLKCFNRLLSAVLQGYKGRCEGLSMQLGQREAEATALHLALQYSEHCEEAYRVLLALREADSGAGDEAPMSDLQAAEKEAWRLLAQEEAAMDAGTQQNPQPSPEGSSVDKPTPQEVAFQLRSYVQRLQERRSLVKILSEPGPTLAPMPIVPRAEAMVQAILGTQAGPALPRLEKTQIQQDLVAAREALADLMLRLQLVRREKRGLELREAALRALGPAHVLLLEQLRWERAELQAGGANSSGGHSSGGGSSGDEEEWYQGLPAVPGGTSGIDGGQVGRAWDPEKLAQELAASLTRTLDLQEQLQSLRRELEQVAQKGRARRSQSAELNRDLCKAHSALVLAFRGAHRKQEEQRRKLEQQMALMEAQQAEEVAVLEATARALGKPRPPLPPPQLGDTFL

SEQ ID NO: 813 - protein, 405 aa, Homo sapiens
MLSSFLSPQNGTWADTFSLLLALAVALYLGYYWACVLQRPRLVAGPQFLAFLEPHCSITTETFYPTLWCFEGRLQSIFQVLLQSQPLVLYQSDILQTPDGGQLLLDWAKQPDSSQDPDPTTQPIVLLLPGITGSSQETYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRSLETPLNSLLFNQPLTAGLCQLVERNRKVIEKVVDIDFVLQARTIRQFDERYTSVAFGYQDCVTYYKAASPRTKIDAIRIPVLYLSAADDPFSPVCALPIQAAQHSPYVALLITARGGHIGFLEGLLPWQHWYMSRLLHQYAKAIFQDPEGLPDLRALLPSEDRNS

SEQ ID NO: 814 - protein, 901 aa, Homo sapiens
MMMVMQPEGLGAGEGRFAGGGGGGEYMEQEEDWDRDLLLDPAWEKQQRKTFTAWCNSHLRKAGTQIENIEEDFRNGLKLMLLLEVISGERLPRPDKGKMRFHKIANVNKALDFIASKGVKLVSIGAEEIVDGNLKMTLGMIWTIILRFAIQDISVEETSAKEGLLLWCQRKTAPYRNVNVQNFHTSWKDGLALCALIHRHRPDLIDYAKLRKDDPIGNLNTAFEVAEKYLDIPKMLDAEDIVNTPKPDEKAIMTYVSCFYHAFAGAEQAETAANRICKVLAVNQENEKLMEEYEKLASELLEWIRRTVPWLENRVGEPSMSAMQRKLEDFRDYRRLHKPPRIQEKCQLEINFNTLQTKLRLSHRPAFMPSEGKLVSDIANAWRGLEQVEKGYEDWLLSEIRRLQRLQHLAEKFRQKASLHEAWTRGKEEMLSQRDYDSALLQEVRALLRRHEAFESDLAAHQDRVEHIAALAQELNELDYHEAASVNSRCQAICDQWDNLGTLTQKRRDALERMEKLLETIDQLQLEFARRAAPFNNWLDGAVEDLQDVWLVHSVEETQSLLTAHDQFKATLPEADRERGAIMGIQGEIQKICQTYGLRPCSTNPYITLSPQDINTKWDMVRKLVPSRDQTLQEELARQQVNERLRRQFAAQANAIGPWIQAKVEEVGRLAAGLAGSLEEQMAGLRQQEQNIINYKTNIDRLEGDHQLLQESLVFDNKHTVYSMEHIRVGWEQLLTSIARTINEVENQVLTRDAKGLSQEQLNEFRASFNHFDRKRNGMMEPDDFRACLISMGYDLGEVEFARIMTMVDPNAAGVVTFQAFIDFMTRETAETDTTEQVVASFKILAGDKNYITPEELRRELPAKQAEYCIRRMVPYKGSGAPAGALDYVAFSSALYGESDL

SEQ ID NO: 815 - protein, 3924 aa, Homo sapiens [sequence omitted]

SEQ ID NO: 816 - protein, 295 aa, Homo sapiens
MSKSTKLCGKTSCPRSNIFCNLLDKIVKRPSLQFLGQWGYHCYEPRIYRSLAKILRYVDLDGFDALLTDYIAFVEKSGYRFEVSFNLDFTEICVNTILYWVFARKGNPDFVELLLKKTKDYVQDRSCNLALIWRTFTPVYCPSPLSGITPLFYVAQTRQSNIFKILLQYGILEREKNPINIVLTIVLYPSRVRVMVDRELADIHEDAKTCLVLCSRVLSVISVKEIKTQLSLGRHPIISNWFDYIPSTRYKDPCELLHLCRLTIRNQLLTNNMLPDGIFSLLIPARLQNYLNLEI

SEQ ID NO: 817 - protein, 458 aa, Homo sapiens [sequence omitted]

SEQ ID NO: 818 - protein, 594 aa, Homo sapiens
MESNHKSGDGLSGTQKEAALRALVQRTGYSLVQENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVREIYMNVPVGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 819 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 820 - protein, 351 aa, Homo sapiens
MEGAALLKIFVVCIWVQQNHPGWTVAGQFQEKKRFTEEVIEYFQKKVSPVHLKILLTSDEAWKRFVRVAELPREEADALYEALKNLTPYVAIEDKDMQQKEQQFREWFLKEFPQIRWKIQESIERLRVIANEIEKVHRGCVIANVVSGSTGILSVIGVMLAPFTAGLSLSITAAGVGLGIASATAGIASSIVENTYTRSAELTASRLTATSTDQLEALRDILRDITPNVLSFALDFDEATKMIANDVHTLRRSKATVGRPLIAWRYVPINVVETLRTRGAPTRIVRKVARNLGKATSGVLVVLDVVNLVQDSLDLHKGAKSESAESLRQWAQELEENLNELTHIHQSLKAG

SEQ ID NO: 821 - protein, 1090 aa, Homo sapiens
MMPMILTVFLSNNEQILTEVPITPETTCRDVVEFCKEPGEGSCHLAEVWRGNERPIPFDHMMYEHLQIWGPRREEVKFFLRHEDSPTENSEQGGRQTQEQRTQRNVINVPGDKRTEYGVGNPRVELTLSELQDMAARQQQQIENQQQMLVAKEQRLHFLKQQERRQQQSISENEKLQKLKERVEAQENKLKKIRAMRGQVDYSKIMNGNLSAEIERFSAMFQEKKQEVQTAILRVDQLSQQLEDLKKGKLNGFQSYNGKLTGPAAVELKRLYQELQIRNQLNQEQNSKLQQQKELLNKRNMEVAMMDKRISELRERLYGKKIQLNRVNGTSSPQSPLSTSGRVAAVGPYIQVPSAGSFPVLGDPIKPQSLSIASNAAHGRSKSANDGNWPTLKQNSSSSVKPVQVAGADWKDPSVEGSVKQGTVSSQPVPFSALGPTEKPGIEIGKVPPPIPGVGKQLPPSYGTYPSPTPLGPGSTSSLERRKEGSLPRPSAGLPSRQRPTLLPATGSTPQPGSSQQIQQRISVPPSPTYPPAGPPAFPAGDSKPELPLTVAIRPFLADKGSRPQSPRKGPQTVNSSSIYSMYLQQATPPKNYQPAAHSALNKSVKAVYGKPVLPSGSTSPSPLPFLHGSLSTGTPQPQPPSESTEKEPEQDGPAAPADGSTVESLPRPLSPTKLTPIVHSPLRYQSDADLEALRRKLANAPRPLKKRSSITEPEGPGGPNIQKLLYQRFNTLAGGMEGTPFYQPSPSQDFMGTLADVDNGNTNANGNLEELPPAQPTAPLPAEPAPSSDANDNELPSPEPEELICPQTTHQTAEPAEDNNNNVATVPTTEQIPSPVAEAPSPGEEQVPPAPLPPASHPPATSTNKRTNLKKPNSERTGHGLRVRFNPLALLLDASLEGEFDLVQRIIYEVEDPSKPNDEGITPLHNAVCAGHHHIVKFLLDFGVNVNAADSDGWTPLHCAASCNSVHLCKQLVESGAAIFASTISDIETAADKCEEMEEGYIQCSQFLYGVQEKLGVMNKGVAYALWDYEAQNSDELSFHEGDALTILRRKDESETEWWWARLGDREGYVPKNLLGLYPRIKPRQRTLA

SEQ ID NO: 822 - protein, 1749 aa, Homo sapiens
MAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHGAHGNNLIAVLAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKRELGSVDEILGPLTEILEGVLQADQQLMEKTKAKVFSAFITVLQMKEMKVSDIPQYSQLVLNVCETLQEEVIALFDQTRHSLALGSATEDKDSMETDDCSRSRHRDQRDGVCVLGLHLAKELCEVDEDGDSWLQVTRRLPILPTLLTTLEVSLRMKQNLHFTEATLHLLLTLARTQQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVNLGYLCQACTSLLHSRKMLQHYLQNKNGDGLPSAVAQRVQRPPSAASAAPSSSKQPAADTEASEQQALHTVQYGLLKILSKTLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 823 - protein, 557 aa, Homo sapiens
MDSDEGYNYEFDEDEECSEEDSGAEEEEDEDDDEPDDDTLDLGEVELVEPGLGVGGERDGLLCGETGGGGGSALGPGGGGGGGGGGGGGGPGHEQEEDYRYEVLTAEQILQHMVECIREVNEVIQNPATITRILLSHFNWDKEKLMERYFDGNLEKLFAECHVINPSKKSRTRQMNTRSSAQDMPCQICYLNYPNSYFTGLECGHKFCMQCWSEYLTTKIMEEGMGQTISCPAHGCDILVDDNTVMRLITDSKVKLKYQHLITNSFVECNRLLKWCPAPDCHHVVKVQYPDAKPVRCKCGRQFCFNCGENWHDPVKCKWLKKWIKKCDDDSETSNWIAANTKECPKCHVTIEKDGGCNHMVCRNQNCKAEFCWVCLGPWEPHGSAWYNCNRYNEDDAKAARDAQERSRAALQRYLFYCNRYMNHMQSLRFEHKLYAQVKQKMEEMQQHNMSWIEVQFLKKAVDVLCQCRATLMYTYVFAFYLKKNNQSIIFENNQADLENATEVLSGYLERDISQDSLQDIKQKVQDKYRYCESRRRVLLQHVHEGYEKDLWEYIED

SEQ ID NO: 824 - protein, 628 aa, Homo sapiens
MAAAGAGPGQEAGAGPGPGAVANATGAEEGEMKPVAAGAAAPPGEGISAAPTVEPSSGEAEGGEANLVDVSGGLETESSNGKDTLEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQDLSNIGPAYDNQKQSSAVSTSGNLNGGIAAGSSGKGRGAKRKQQDGGTTGTTKKARSDPLFSAQRLPPHGYPLEHPFNKDGYRYILAEPDPHAPDPEKLELDCWAGKPIPGDLYRACLYERVLLALHDRAPQLKISDDRLTVVGEKGYSMVRASHGVRKGAWYFEITVDEMPPDTAARLGWSQPLGNLQAPLGYDKFSYSWRSKKGTKFHQSIGKHYSSGYGQGDVLGFYINLPEDTETAKSLPDTYKDKALIKFKSYLYFEEKDFVDKAEKSLKQTPHSEIIFYKNGVNQGVAYKDIFEGVYFPAISLYKSCTVSINFGPCFKYPPKDLTYRPMSDMGWGAVVEHTLADVLYHVETEVDGRRSPPWEP

SEQ ID NO: 825 - protein, 68 aa, Homo sapiens [sequence omitted]

SEQ ID NO: 826 - protein, 684 aa, Homo sapiens
MVIPLNGTIMPCDAVLINGTCIVNESMLTGESVPVTKTNLPNPSVDVKGIGDELYNPETHKRHTLFCGTTVIQTRFYTGELVKAIVVRTGFSTSKGQLVRSILYPKPTDFKLYRDAYLFLLCLVAVAGIGFIYTIINSILNEVQVGVIIIESLDIITITVPPALPAAMTAGIVYAQRRLKKIGIFCISPQRINICGQLNLVCFDKTGTLTEDGLDLWGIQRVENARFLSPEENVCNEMLVKSQFVACMATCHSLTKIEGVLSGDPLDLKMFEAIGWILEEATEEETALHNRIMPTVVRPPKQLLPESTPAGNQEMELFELPATYEIGIVRQFPFSSALQRMSVVARVLGDRKMDAYMKGAPEAIAGLCKPETVPVDFQNVLEDFTKQGFRVIALAHRKLESKLTWHKVQNISRDAIENNMDFMGLIIMQNKLKQETPAVLEDLHKANIRTVMVTGDSMLTAVSVARDCGMILPQDKVIIAEALPPKDGKVAKINWHYADSLTQCSHPSAIDPEAIPVKLVHDSLEDLQMTRYHFAMNGKSFSVILEHFQDLVPKLMLHGTVFARMAPDQKTQLIEALQNVDYFVGMCGDGANDCGALKRAHGGISLSELEASVASPFTSKTPSISCVPNLIREGRAALITSSCELALFSIVTYSLDHFIISILISSMLVLFFSDFHNCAFYSLV

SEQ ID NO: 827 - protein, 1164 aa, Homo sapiens
MPTMRRTVSEIRSRAEGYEKTDDVSEKTSLADQEEVRTIFINQPQLTKFCNNHVSTAKYNIITFLPRFLYSQFRRAANSFFLFIALLQQIPDVSPTGRYTTLVPLLFILAVAAIKEIIEDIKRHKADNAVNKKQTQVLRNGAWEIVHWEKVAVGEIVKVTNGEHLPADLISLSSSEPQAMCYIETSNLDGETNLKIRQGLPATSDIKDVDSLMRISGRIECESPNRHLYDFVGNIRLDGHGTVPLGADQILLRGAQLRNTQWVHGIVVYTGHDTKLMQNSTSPPLKLSNVERITNVQILILFCILIAMSLVCSVGSAIWNRRHSGKDWYLNLNYGGASNFGLNFLTFIILFNNLIPISLLVTLEVVKFTQAYFINWDLDMHYEPTDTAAMARTSNLNEELGQVKYIFSDKTGTLTCNVMQFKKCTIAGVAYGHVPEPEDYGCSPDEWQNSQFGDEKTFSDSSLLENLQNNHPTAPIICEFLTMMAVCHTAVPEREGDKIIYQAASPDEGALVRAAKQLNFVFTGRTPDSVIIDSLGQEERYELLNVLEFTSARKRMSVIVRTPSGKLRLYCKGADTVIYDRLAETSKYKEITLKHLEQFATEGLRTLCFAVAEISESDFQEWRAVYQRASTSVQNRLLKLEESYELIEKNLQLLGATAIEDKLQDQVPETIETLMKADIKIWILTGDKQETAINIGHSCKLLKKNMGMIVINEGSLDGTRETLSRHCTTLGDALRKENDFALIIDGKTLKYALTFGVRQYFLDLALSCKAVICCRVSPLQKSEVVEMVKKQVKVVTLAIGDGANDVSMIQTAHVGVGISGNEGLQAANSSDYSIAQFKYLKNLLMIHGAWNYNRVSKCILYCFYKNIVLYIIEIWFAFVNGFSGQILFERWCIGLYNVMFTAMPPLTLGIFERSCRKENMLKYPELYKTSQNALDFNTKVFWVHCLNGLFHSVILFWFPLKALQYGTAFGNGKTSDYLLLGNFVYTFVVITVCLKAGLETSYWTWFSHIAIWGSIALWVVFFGIYSSLWPAIPMAPDMSGEAAMLFSSGVFWMGLLFIPVASLLLDVVYKVIKRTAFKTLVDEVQELEAKSQDPGAVVLGKSLTERAQLLKNVFKKNHVNLYRSESLQQNLLHGYAFSQDENGIVSQSEVIRAYDTTKQRPDEW

SEQ ID NO: 828 - protein, 1543 aa, Homo sapiens
  misc_feature (181)..(181): Xaa can be any naturally occurring amino acid
MNKMALASFMKGRTVIGTPDEETMDIELPKKYHEMVGVIFSDTFSYRLKFNWGYRIPVIKEHSEYTEHCWAMHGEIFCYLAKYWLKGFVAFQAAINAAIIEVTTNHSVMEELTSVIGINMKIPPFISKGEIMNEWFHFTCLVSFSSFIYFASLNVARERGKFKKLMTVMGLRESAFWLSWXLTYICFIFIMSIFMALVITSISIVFHTGFMVIFTLYSLYGLSLIALAFLMSVLIRKPMLAGLAGFLFTVFWGCLGFTVLYRQLPLSLGWVLSLLSPFAFTAGMAQVTHLDNYLSGVIFPDPSGDSYKMIATFFILAFDTLFYLIFTLYFERVLPDKDGHGDSPLFFLKSSFWSKHQNTHHEIFENEINPEHSSDDSFEPVSPEFHGKEAIRIRNVIKEYNGKTGKVEALQGIFFDIYEGQITAILGHNGAGKSTLLNILSGLSVSTEGSATIYNTQLSEITDMEEIRKNIGFCPQFNFQFDFLTVRENLRVFAKIKGIQPKEVEQEVKRIIMELDMQSIQDIIAKKLSGGQKRKLTLGIAILGDPQVLLLDEPTAGLDPFSRHRVWSLLKEHKVDRLILFSTQFMDEADILADRKVFLSNGKLKCAGSSLFLKRKWGIGYHLSLHRNEMCDTEKITSLIKQHIPDAKLTTESEEKLVYSLPLEKTNKFPDLYSDLDKCSDQGIRNYAVSVTSLNEVFLNLEGKSAIDEPDFDIGKQEKIHVTRNTGDESEMEQVLCSLPETRKAVSSAALWRRQIYAVATLRFLKLRRERRALLCLLLVLGIAFIPIILEKIMYKVTRETHCWEFSPSMYFLSLEQIPKTPLTSLLIVNNTGSNIEDLVHSLKCQDIVLEIDDFRNRNGSDDPSYNGAIIVSGDQKDYRFSVACNTKKLNCFPVLMGIVSNALMGIFNFTELIQTESTSFSRDDIVLDLGFIDGSIFLLLITNCVSPFIGMSSISDYKKNVQSQLWISGLWPSAYWCGQALVDIPLYFLILFSIHLIYYFIFLGFQLSWELMFVLVVCIIGCAVSLIFLTYVLSFIFRKWRKNNGFWSFGFFIILICVSTIMVSTQYEKLNLILCMIFIPSFTLLGYVMLLIQLDFMRNLDSLDNRINEVNKTILLTTLIPYLQSVIFLFVIRCLEMKYGNEIMNKDPVFRISPRSRETHPNPEEPEEEDEDVQAERVQAANALTAPNLEEEPVITASCLHKEYYETKKSCFSTRKKKIAIRNVSFCVKKGEVLGLLGHNGAGKSTSIKMITGCTKPTAGVVVLQGSRASVRQQHDNSLKFLGYCPQENSLWPKLTMKEHLELYAAVKGLGKEDAALSISRLVEALKLQEQLKAPVKTLSEGIKRKLCFVLSILGNPSVVLLDEPFTGMDPEGQQQMWQILQATVKNKERGTLLTTHYMSEAEAVCDRMAMMVSGTLRCIGSIQHLKNKFGRDYLLEIKMKEPTQVEALHTEILKLFPQAAWQERYSSLMAYKLPVEDVHPLSRAFFKLEAMKQTFNLEEYSLSQATLEQVFLELCKEQELGNVDDKIDTTVEWKLLPQEDP

SEQ ID NO: 829 - protein, 2436 aa, Homo sapiens [sequence omitted]

SEQ ID NO: 830 - protein, 1401 aa, Homo sapiens
MASCASIDIEDATQHLRDILKLDRPAGGPSAESPRPSSAYNGDLNGLLVPDPLCSGDSTSANKTGLRTMPPINLQEKQVICLSGDDSSTCIGILAKEVEIVASSDSSISSKARGSNKVKIQPVAKYDWEQKYYYGNLIAVSNSFLAYAIRAANNGSAMVRVISVSTSERTLLKGFTGSVADLAFAHLNSPQLACLDEAGNLFVWRLALVNGKIQEEILVHIRQPEGTPLNHFRRIIWCPFIPEESEDCCEESSPTVALLHEDRAEVWDLDMLRSSHSTWPVDVSQIKQGFIVVKGHSTCLSEGALSPDGTVLATASHDGYVKFWQIYIEGQDEPRCLHEWKPHDGRPLSCLLFCDNHKKQDPDVPFWRFLITGADQNRELKMWCTVSWTCLQTIRFSPDIFSSVSVPPSLKVCLDLSAEYLILSDVQRKVLYVMELLQNQEEGHACFSSISEFLLTHPVLSFGIQVVSRCRLRHTEVLPAEEENDSLGADGTHGAGAMESAAGVLIKLFCVHTKALQDVQIRFQPQLNPDVVAPLPTHTAHEDFTFGESRPELGSEGLGSAAHGSQPDLRRIVELPAPADFLSLSSETKPKLMTPDAFMTPSASLQQITASPSSSSSGSSSSSSSSSSSLTAVSAMSSTSAVDPSLTRPPEELTLSPKLQLDGSLTMSSSGSLQASPRGLLPGLLPAPADKLTPKGPGQVPTATSALSLELQEVEPLGLPQASPSRTRSPDVISSASTALSQDIPEIASEALSRGFGSSAPEGLEPDSMASAASALHLLSPRPRPGPELGPQLGLDGGPGDGDRHNTPSLLEAALTQEASTPDSQVWPTAPDITRETCSTLAESPRNGLQEKHKSLAFHRPPYHLLQQRDSQDASAEQSDHDDEVASLASASGGFGTKVPAPRLPAKDWKTKGSPRTSPKLKRKSKKDDGDAAMGSRLTEHQVAEPPEDWPALIWQQQRELAELRHSQEELLQRLCTQLEGLQSTVTGHVERALETRHEQEQRRLERALAEGQQRGGQLQEQLTQQLSQALSSAVAGRLERSIRDEIKKTVPPCVSRSLEPMAGQLSNSVATKLTAVEGSMKENISKLLKSKNLTDAIARAAADTLQGPMQAAYREAFQSVVLPAFEKSCQAMFQQINDSFRLGTQEYLQQLESHMKSRKAREQEAREPVLAQLRGLVSTLQSATEQMAATVAGSVRAEVQHQLHVAVGSLQESILAQVQRIVKGEVSVALKEQQAAVTSSIMQAMRSAAGTPVPSAHLDCQAQQAHILQLLQQGHLNQAFQQALTAADLNLVLYVCETVDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGLVTPSLP

SEQ ID NO: 831 - protein, 4490 aa, Homo sapiens
MMKLYIDNAAPDKLKGLCIFFVRCRNDVAINVKTIQEEALFTVLDASKGLLNGIRDMLANIFLPAVLATNNWGALNQSKQGESEKHIFTETINRYLSFLDGARISIEGTVKLKTIDNVNFSKLHTFEEVTAAASNSETVHQLEEVLMVWYKQIEQVLIESEQMRKEAGDSGPLTELEHWKRMSAKFNYIIEQIKGPSCKAVINVLNVAHSKLLKNWRDLDARITDTANESKDNVRYLYTLEKVCQPLYNHDLVSMAHGIQNLINAIRMIHGVSRYYNTSERMTSLFIKVTNQMVTACKAYITDGGLNHVWDQETPVVLKKIQDCIFLFKEYQASFHKTRKLISESSGEKSFEVSEMYIFGKFEAFCKRLEKITEMITVVQTYSTLSNSTIEGIDIMAIKFRNIYQGVKKKQYDILDPRRTEFDTDFLDFMTKINGLEVQIQAFMNSSFGKILSSQQALQLLQRFQKLNIPCLGLEINHTIERILQYYVAELDATKKLYHSQKDDPPLARNMPPIAGKILWVRQLYRRISEPINYFFKNSDILSSPDGKAVIRQYNKISYVLVEFEVVYHTAWVREISQLHYALQATLFVRHPETGKLLVNFDPKILEVVRETKCMIKMKLDVPEQAKRLLKLESKLKADKLYLQGLLQYYDELCQEVPSVFVNLMTPKMKKVESVLRQGLTVLTWSSLTLESFFQEVELVLDMFNQLLKKISDLCEMHIDTVLKEIAKTVLISLPESGATKVEDMLTLNETYTKEWADILNHKSKHVEEAVRELISIFEQIYEVKYTGKVGKQSEQRKHVVFGSETEEGENNDYEANIVNEFDTHDKEDEFKKECKEVFAFFSHQLLDSLQKATRLSLDTMKRRIFVASLYGRKQSEDIISFIKSEVHLAIPNVVMIPSLDDIQQAINRMIQLTLEVSRGVAHWGQQQIRPIKSVIPSPTTTDVTHQNTGKLLKKEERSFEEAIPARKLKNFYPGVAEHKDISKLVLLLSSSVNSLRKAAHEALQDFQKYKTLWTEDRDVKVKEFLANNPSLTEIRSEILHYATFEQEIDELKPIIVVGALELHTEPMKLALSIEAKAWKMLLCRYLNEEYKKKMSYMIAFINEYLKKLSRPIRDLDDVRFAMEALSCIRDNEIQMDMTLGPIEEAYAILNRFEVEVTKEESEAVDTLRYSFNKLQSKAVSVQEDLVQVQPKFKSNLLESVKVFREDVINFAEAYELEGPMVPNIPPQEASNRLQIFQASFDDLWRKFVTYSSGEQLFGLPVTDYEVLHKTRKELNLLQKLYGLYDTVMSSISGYYEILWGDVDIEKINAELLEFQNRCRKLPKGLKDWQAFLDLKKRIDDFSESCPLLEMMTNKAMKQRHWDRISELTGTPFDVESDSFCLRNIMEAPLLKHKDDIEDICISAIKEKDIEAKLTQVIENWTNQNLSFAAFKGKGELLLKGTESGEIITLMEDSLMVLGSLLSNRYNAPFKKNIQNWVYKLSTSSDIIEEWLVVQNLWVYLEAVFVGGDIAKQLPQEAKRFQNIDKSWIKIMQRAHENPNVINCCVGDETMGQLLPHLHEQLEVCQKSLTGYLEKKRLLFPRFFFVSDPVLLEILGQASDSHTIQPHLPAVSDNINEVTFHTKDYDRIMAVISREGEKIVLDNSVMAKGPVEIWLLDLLKMQMSSLHNIIRSAFYQISDSGFQLLPFLSHFPAQVGLLGIQMLWTHDSEEALRNAKDDRKIMQVTNQKFLDILNTLISQTTHDLSKFDRVKFETLITIHVHQRDIFDDLVKMHIKSPTDFEWLKQSRFYFKEDLDQTVVSITDVDFIYQNEFLGCTDRLVITPLTDRCYITLAQALGMNMGGAPAGPAGTGKTETTKDMGRCLGKYVVVFNCSDQMDFRGLGRIFKGLAQSGSWGCFDEFNRIELPVLSVAAQQIYIVLTARKERKKQFIFSDGDCVDLNPEFGIFLTMNPGYAGRQELPENLKIQFRTVAMMVPDRQIIMRVKLASCGFLENVILAQKFYVLYKLCEEQLTKQVHYDFGLRNILSVLRTLGSQKRARPEDSELSIVMRGLRDMNLSKLVDEDEPLFLSLINDLFPGLQLDSNTYAELQNAVAHQVQIEGLINHPPWNLKLVQLYETSLVRHGLMTLGPSGSGKTTVITILMKAQTECGRPHREMRMNPKAITAPQMFGRLDTATNDWTDGIFSTLWRKTLKAKKGENIFLILDGPVDAIWIENLNSVLDDNKTLTLANGDRIPMAPSCKLLFEVHNIENASPATVSRMGMVYISSSALSWRPILQAWLKKRTAQEAAVFLTLYEKVFEDTYTYMKLNLNPKMQLLECNYIVQSLNLLEGLIPSKEEGGVSCVEHLHKLFVFGLMWSLGALLELESREKLEAFLRQHESKLDLPEIPKGSNQTMYEFYVTDYGDWEHWNKKLQPYYYPTDSIPEYSSILVPNVDNIRTNFLIDTIAKQHKAVLLTGEQGTAKTVMVKAYLKKYDPEVQLSKSLNFSSATEPMMFQRTIESYVDKRIGSTYGPPGGRKMTVFIDDINMPVINEWGDQITNEIVRQMMEMEGMYSLDKPGDFTTIVDVQLIAAMIHPGGGRNDIPQRLKRQFTVFNCTLPSNASIDKIFGIIGCGYFDPCRSFKPQICEMIVNLVSVGRVLWQWTKVKMLPTPSKFHYIFNLRDLSRIWQGMLTIKAEECASIPTLLSLFKHECSRVIADRFITPEDEQWFNAHLTRAVEENIGSDAASCILPEPYFVDFLREMPEPTGDEPEDSVFEVPKIYELMPSFDFLAEKLQFYQRQFNEIIRGTSLDLVFFKDAMTHLIKISRIIRTSCGNALLVGVGGSGKQSLSRLASFIAGYQIFQITLTRSYNVTNLTDDLKALYKVAGADGKGITFIFTDSEIKDEAFLEYLNNLLSSGEISNLFARDEMDEITQGLISVMKRELPRHPPTFDNLYEYFISRSRKNLHVVLCFSPVGEKFRARSLKFPGLISGCTMDWFSRWPREALIAVASYFLSDYNIVCSSEIKRQVVETMGLFHDMVSESCESYFQRYRRRAHVTPKSYLSFINGYKNIYAEKVKFINEQAERMNIGLDKLMEASESVAKLSQDLAVKEKELAVASIKADEVLAEVTVSAQASAKIKNEVQEVKDKAQKIVDEIDSEKVKAESKLEAAKPALEEAEAALNTIKPNDIATVRKLAKPPHLIMRIMDCVLLLFQKKIDPVTMDPEKSCCKPSWGESLKLMSATGFLWSLQQFPKDTINEETVELLQPYFNMDDYTFESAKKVCGNVAGLLSWTLAMAIFYGINREVLPLKANLAKQEGRLAVANAELGKAQALLDEKQAELDKVQAKFDAAMNEKMDLLNDADTCRKKMQAASTLIDGLSGEKIRWTQQSKEFKAQINRLVGDILLCTGFLSYLGPFNQIFRNYLLKDQWEMELRARKIPFTENLNLISMLVDPPTIGEWGLQGLPGDDLSIQNGIIVTKATRYPLLIDPQTQGKTWIKSKEKENDLQVTSLNRKYFRTHLEDSLSLGRPLLIEDIHEELDPALDNVLEKNFIKSGTTFKVKVGDKECDIMDTFKLYITTKLPNPAFTPEINAKTSVIDFTVTMKGLENQLLRRVILTEKQELEAERVKLLEDVTFNKRKMKELEDNLLYKLSATKGSLVDDESLIGVLRTTKQTAAEVSEKLHVAAETEIKINAAQEEFRPAATRGSILYFLITEMSMVNIMYQTSLAQFLKLFDQSMARSEKSPLPQKRITNIIEYLTYEVFTYSVRGLYENHKFLFVLLMTLKIDLQRGTVKHREFQALIKGGAALDLKACPPKPYRWILDMTWLNLVELSKLPQFAEIMNQISRNEKGWKSWFDKDAPEEEIIPDGYNDSLDTCHKLLLIRSWCPDRTVFQARKYIADSLEEKYTEPVILNLEKTWEESDTRTPLICFLSMGSDPTNQIDALAKKLKLECRTISMGQGQEVHARKLIQMSMQQGGWVLLQNCHLGLEFMEELLETLITTEASDDSFRVWITTEPHDRFPITLLQTSLKFTNEPPQGVRAGLKRTFAGINQDLLDISNLPMWKPMLYTVAFLHSTVQERRKFGPLGWNIPYEFNSADFSASVQFIQNHLDECDIKKGVSWNTVRYMIGEVQYGDRVTDDFDKRLLNCFARVWFSEKMFEPSFCFYTGYKIPLCKTLDQYFEYIQSLPSLDNPEVFGLHPNADITYQSNTASAVLETITNIQPKESGGGVGETREAIVYRLSEDMLSKLPPDYIPHEVKSRLIKMGHLNSMNIFLRQEIDRMQRVISVLRSSLSDLKLAIEGTIIMSENLRDALDNMYDARIPQLWKRVSWDSSTLGFWFTELLERNAQFSTWIFEGRPNVFWMTGFFNPQGFLTAMRQEVTRAHKGWALDTVTIHNEVLRQTKEEITSPPGEGVYIYGLYMDGAAWDRRNGKLMESTPKVLFTQLPVLHIFAINSTAPKDPKLYVCPIYKKPRRTDLTFITVVYLRTVLSPDHWILRGVALLCDIK

SEQ ID NO: 832 - protein, 500 aa, Homo sapiens
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 833 - protein, 913 aa, Homo sapiens
MGDSRDLCPHLDSIGEVTKEDLLLKSKGTCQSCGVTGPNLWACLQVACPYVGCGESFADHSTIHAQAKKHNLTVNLTTFRLWCYACEKEVFLEQRLAAPLLGSSSKFSEQDSPPPSHPLKAVPIAVADEGESESEDDDLKPRGLTGMKNLGNSCYMNAALQALSNCPPLTQFFLECGGLVRTDKKPALCKSYQKLVSEVWHKKRPSYVVPTSLSHGIKLVNPMFRGYAQQDTQEFLRCLMDQLHEELKEPVVATVALTEARDSDSSDTDEKREGDRSPSEDEFLSCDSSSDRGEGDGQGRGGGSSQAETELLIPDEAGRVISEKERMKDRKFSWGQQRTNSEQVDEDADVDTAMAALDQPAEAQPPSPRSSSPCRTPEPDNDAHLRSSSRPCSPVHHHEGHAKLSSSPPRASPVRMAPSYVLKKAQVLSAGSRRRKEQRYRSVISDIFDGSILSLVQCLTCDRVSTTVETFQDLSLPIPGKEDLAKLHSAIYQNVPAKPGACGDSYAAQGWLAFIVEYIRRFVVSCTPSWFWGPVVTLEDCLAAFFAADELKGDNMYSCERCKKLRNGVKYCKVLRLPEILCIHLKRFRHEVMYSFKINSHVSFPLEGLDLRPFLAKECTSQITTYDLLSVICHHGTAGSGHYIAYCQNVINGQWYEFDDQYVTEVHETVVQNAEGYVLFYRKSSEEAMRERQQVVSLAAMREPSLLRFYVSREWLNKFNTFAEPGPITNQTFLCSHGGIPPHKYHYIDDLVVILPQNVWEHLYNRFGGGPAVNHLYVCSICQVEIEALAKRRRIEIDTFIKLNKAFQAEESPGVIYCISMQWFREWEAFVKGKDNEPPGPIDNSRIAQVKGSGHVQLKQGADYGQISEETWTYLNSLYGGGPEIAIRQSVAQPLGPENLHGEQKIEAETRAV

SEQ ID NO: 834 - protein, 715 aa, Homo sapiens
MDLILNRMDYLQVGVTSQKTMKLIPASRHRATQKVVIGDHDGVVMCFGMKKGEAAAVFKTLPGPKIARLELGGVINTPQEKIFIAAASEIRGFTKRGKQFLSFETNLTESIKAMHISGSDLFLSASYIYNHYCDCKDQHYYLSGDKINDVICLPVERLSRITPVLACQDRVLRVLQGSDVMYAVEVPGPPTVLALHNGNGGDSGEDLLFGTSDGKLALIQITTSKPVRKWEIQNEKKRGGILCIDSFDIVGDGVKDLLVGRDDGMVEVYSFDNANEPVLRFDQMLSESVTSIQGGCVGKDSYDEIVVSTYSGWVTGLTTEPIHKESGPGEELKINQEMQNKISSLRNELEHLQYKVLQERENYQQSSQSSKAKSAVPSFGINDKFTLNKDDASYSLILEVQTAIDNVLIQSDVPIDLLDVDKNSAVVSFSSCDSESNDNFLLATYRCQADTTRLELKIRSIEGQYGTLQAYVTPRIQPKTCQVRQYHIKPLSLHQRTHFIDHDRPMNTLTLTGQFSFAEVHSWVVFCLPEVPEKPPAGECVTFYFQNTFLDTQLESTYRKGEGVFKSDNISTISILKDVLSKEATKRKINLNISYEINEVSVKHTLKLIHPKLEYQLLLAKKVQLIDALKELQIHEGNTNFLIPEYHCILEEADHLQEEYKKQPAHLERLYGMITDLFIDKFKFKGTNVKTKVPLLLEILDSYDQNALISFFDAA

SEQ ID NO: 835 - protein, 2157 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 836 - protein, 213 aa, Homo sapiens
MEVLRRSSVFAAEIMDAFDRWPTDKELVAQAKALGREYVHARLLRAGLSWSAPERASPAPGGRLAEVCTVLLRLGDELEQIRPSVYRNVARQLHIPLQSEPVVTDAFLAVAGHIFSAGITWGKVVSLYSAAAGLAVDCVRQAQPAMVHALVDCLGEFVRKTLATWLRRRGGWTDVLKCVVSTKPGFRSHWLVATLCSFGRFLKAAFFLLLPER

SEQ ID NO: 837 - protein, 2863 aa, Homo sapiens
MASEDNRVPSPPPTGDDGGGGGREETPTEGGALSLKPGLPIRGIRMKFAVLTGLVEVGEVSNRDIVETVFNLLVGGQFDLEMNFIIQEGESINCMVDLLEKCDITCQAEVWSMFTAILKKSIRNLQVCTEVGLVEKVLGKIEKVDNMIADLLVDMLGVLASYNLTVRELKLFFSKLQGDKGRWPPHAGKLLSVLKHMPQKYGPDAFFNFPGKSAAAIALPPIAKWPYQNGFTFHTWLRMDPVNNINVDKDKPYLYCFRTSKGLGYSAHFVGGCLIVTSIKSKGKGFQHCVKFDFKPQKWYMVTIVHIYNRWKNSELRCYVNGELASYGEITWFVNTSDTFDKCFLGSSETADANRVFCGQMTAVYLFSEALNAAQIFAIYQLGLGYKGTFKFKAESDLFLAEHHKLLLYDGKLSSAIAFTYNPRATDAQLCLESSPKDNPSIFVHSPHALMLQDVKAVLTHSIQSAMHSIGGVQVLFPLFAQLDYRQYLSDEIDLTICSTLLAFIMELLKNSIAMQEQMLACKGFLVIGYSLEKSSKSHVSRAVLELCLAFSKYLSNLQNGMPLLKQLCDHVLLNPAIWIHTPAKVQLMLYTYLSTEFIGTVNIYNTIRRVGTVLLIMHTLKYYYWAVNPQDRSGITPKGLDGPRPNQKEMLSLRAFLLMFIKQLVMKDSGVKEDELQAILNYLLTMHEDDNLMDVLQLLVALMSEHPNSMIPAFDQRNGLRVIYKLLASKSEGIRVQALKAMGYFLKHRPPKRKAEVMLGHGLFSLLAERLMLQTNLITMTTYNVLFEILIEQIGTQVIHKQHPDPDSSVKIQNPQILKVIATLLRNSPQCPESMEVRRAFLSDMIKLFNNSRENRRSLLQCSVWQEWMLSLCYFNPKNSDEQKITEMVYAIFRILLYHAVKYEWGGWRVWVDTLSITHSKVTFEIHKENLANIFREQQGKVDEEIGLCSSTSVQAASGIRRDINVSVGSQQPDTKDSPVCPHFTTNGNENSSIEKTSSLESASNIELQTTNTSYEEMKAEQENQELPDEGTLEETLTNETRNADDLEVSSDIIEAVAISSNSFITTGKDSMTVSEVTASISSPSEEDASEMPEFLDKSIVEEEEDDDYVELKVEGSPTEEANLPTELQDNSLSPAASEAGEKLDMFGNDDKLIFQEGKPVTEKQTDTETQDSKDSGIQTMTASGSSAMSPETTVSQIAVESDLGQMLEEGKKATNLTRETKLINDCHGSVSEASSEQKIAKLDVSNVATDTERLELKASPNVEAPQPHRHVLEISRQHEQPGQGIAPDAVNGQRRDSRSTVFRIPEFNWSQMHQRLLTDLLFSIETDIQMWRSHSTKTVMDFVNSSDNVIFVHNTIHLISQVMDNMVMACGGILPLLSAATSATHELENIEPTQGLSIEASVTFLQRLISLVDVLIFASSLGFTEIEAEKSMSSGGILRQCLRLVCAVAVRNCLECQQHSQLKTRGDKALKPMHSLIPLGKSAAKSPVDIVTGGISPVRDLDRLLQDMDINRLRAVVFRDIEDSKQAQFLALAVVYFISVLMVSKYRDILEPQNERHSQSCTETGSENENVSLSEITPAAFSTLTTASVEESESTSSARRRDSGIGEETATGLGSHVEVTPHTAPPGVSAGPDAISEVLSTLSLEVNKSPETKNDRGNDLDTKATPSVSVSKNVNVKDILRSLVNIPADGVTVDPALLPPACLGALGDLSVEQPVQFRSFDRSVIVAAKKSAVSPSTFNTSIPTNAVSVVSSVDSAQASDMGGESPGSRSSNAKLPSVPTVDSVSQDPVSNMSITERLEHALEKAAPLLREIFVDFAPFLSRTLLGSHGQELLIEGTSLVCMKSSSSVVELVMLLCSQEWQNSIQKNAGLAFIELVNEGRLLSQTMKDHLVRVANEAEFILSRQRAEDIHRHAEFESLCAQYSADKREDEKMCDHLIRAAKYRDHVTATQLIQKIINILTDKHGAWGNSAVSRPLEFWRLDYWEDDLRRRRRFVRNPLGSTHPEATLKTAVEHVCIFKLRENSKATDEDILAKGKQSIRSQALGNQNSENEILLEGDDDTLSSVDEKDLENLAGPVSLSTPAQLVAPSVVVKGTLSVTSSELYFEVDEEDPNFKKIDPKILAYTEGLHGKWLFTEIRSIFSRRYLLQNTALEIFMANRVAVMFNFPDPATVKKVVNFLPRVGVGTSFGLPQTRRISLASPRQLFKASNMTQRWQHREISNFEYLMFLNTIAGRSYNDLNQYPVFPWVITNYESEELDLTLPTNFRDLSKPIGALNPKRAAFFAERYESWEDDQVPKFHYGTHYSTASFVLAWLLRIEPFTTYFLNLQGGKFDHADRTFSSISRAWRNSQRDTSDIKELIPEFYYLPEMFVNFNNYNLGVMDDGTVVSDVELPPWAKTSEEFVHINRLALESEFVSCQLHQWIDLIFGYKQQGPEAVRALNVFYYLTYEGAVNLNSITDPVLREAVEAQIRSFGQTPSQLLIEPHPPRGSAMQVSPLMFTDKAQQDVIMVLKFPSNSPVTHVAANTQPGLATPAVITVTANRLFAVNKWHNLPAHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRAIQLSRDGQYLLTGGDRGVVVVRQVSDLKQLFAYPGCDAGIRAMALSYDQRCIISGMASGSIVLFYNDFNRWHHEYQTRY

SEQ ID NO: 838 - protein, 643 aa, Homo sapiens
MSEETVPEAASPPPPQGQPYFDRFSEDDPEYMRLRNRAADLRQDFNLMEQKKRVTMILQSPSFREELEGLIQEQMKKGNNSSNIWALRQIADFMASTSHAVFPTSSMNVSMMTPINDLHTADSLNLAKGERLMRCKISSVYRLLDLYGWAQLSDTYVTLRVSKEQDHFLISPKGVSCSEVTASSLIKVNILGEVVEKGSSCFPVDTTGFCLHSAIYAARPDVRCIIHLHTPATAAVSAMKWGLLPVSHNALLVGDMAYYDFNGEMEQEADRINLQKCLGPTCKILVLRNHGVVALGDTVEEAFYKIFHLQAACEIQVSALSSAGGVENLILLEQEKHRPHEVGSVQWAGSTFGPMQKSRLGEHEFEALMRMLDNLGYRTGYTYRHPFVQEKTKHKSEVEIPATVTAFVFEEDGAPVPALRQHAQKQQKEKTRWLNTPNTYLRVNVADEVQRSMGSPRPKTTWMKADEVEKSSSGMPIRIENPNQFVPLYTDPQEVLEMRNKIREQNRQDVKSAGPQSQLLASVIAEKSRSPSTESQLMSKGDEDTKDDSEETVPNPFSQLTDQELEEYKKEVERKKLELDETGQEREPGSGPAVCEFFSVALHIWSNILERKKLPQKSLAHLQSLHLLLQCRAQRRRQRQRAL

SEQ ID NO: 839 - protein, 372 aa, Homo sapiens
MKYLRHRRPNATLILAIGAFTLLLFSLLVSPPTCKVQEQPPAIPEALAWPTPPTRPAPAPCHANTSMVTHPDFATQPQHVQNFLLYRHCRHFPLLQDVPPSKCAQPVFLLLVIKSSPSNYVRRELLRRTWGRERKVRGLQLRLLFLVGTASNPHEARKVNRLLELEAQTHGDILQWDFHDSFFNLTLKQVLFLQWQETRCANASFVLNGDDDVFAHTDNMVFYLQDHDPGRHLFVGQLIQNVGPIRAFWSKYYVPEVVTQNERYPPYCGGGGFLLSRFTAAALRRAAHVLDIFPIDDVFLGMCLELEGLKPASHSGIRTSGVRAPSQHLSSFDPCFYRDLLLVHRFLPYEMLLMWDALNQPNLTCGNQTQIY

SEQ ID NO: 840 - protein, 928 aa, Homo sapiens [sequence omitted]

SEQ ID NO: 841 - protein, 195 aa, Homo sapiens
MDCEVNNGSSLRDECITNLLVFGFLQSCSDNSFRRELDALGHELPVLAPQWEGYDELQTDGNRSSHSRLGRIEADSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 842 - protein, 243 aa, Homo sapiens
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARSFGVEWIASWLVVTVPTILGLLLT

SEQ ID NO: 843 - protein, 1038 aa, Homo sapiens
MTSSLQRPWRVPWLPWTILLVSTAAASQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERNLSHNRRVPKIGPYPDYSSSSYIEDSIHHTDSIVKNISSEHSMSSTPLTIGEKNRNSINYERQQAQARIPSPETSVTSLSTNTTTTNTTGLTPSTGMTTISEMPYPDETNLHTTNVAQSIGPTPVCLQLTEEDLETNKLDPKEVDKNLKESSDENLMEHSLKQFSGPDPLSSTSSSLLYPLIKLAVEATGQQDFTQTANGQACLIPDVLPTQIYPLPKQQNLPKRPTSLPLNTKNSTKEPRLKFGSKHKSNLKQVETGVAKMNTINAAEPHVVTVTMNGVAGRNHSVNSHAATTQYANGTVLSGQTTNIVTHRAQEMLQNQFIGEDTRLNINSSPDEHEPLLRREQQAGHDEGVLDRLVDRRERPLEGGRTNSNNNNSNPCSEQDVLAQGVPSTAADPGPSKPRRAQRPNSLDLSATNVLDGSSIQIGESTQDGKSGSGEKIKKRVKTPYSLKRWRPSTWVISTESLDCEVNNNGSNRAVHSKSSTAVYLAEGGTATTMVSKDIGMNCL

SEQ ID NO: 844 - protein, 3060 aa, Homo sapiens
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLNTSRNQERHLDTLHNFVSRATNELIWLNEKEEEEVAYDWSERNTNIARKKDYHAELMRELDQKEENIKSVQEIAEQLLLENHPARLTIEAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKLKTVNLGLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEKSLEEEKKEHVEKAKELQKWVSNISKTLKDAEKAGKPPFSKQKISSEEISTKKEQLSEALQTIQLFLAKHGDKMTDEERNELEKQVKTLQESYNLLFSESLKQLQESQTSGDVKVEEKLDKVIAGTIDQTTGEVLSVFQAVLRGLIDYDTGIRLLETQLMISGLISPELRKCFDLKDAKSHGLIDEQILCQLKELSKAKEIISAASPTTIPVLDALAQSMITESMAIKVLEILLSTGSLVIPATGEQLTLQKAFQQNLVSSALFSKVLERQNMCKDLIDPCTSEKVSLIDMVQRSTLQENTGMWLLPVRPQEGGRITLKCGRNISILRAAHEGLIDRETMFRLLSAQLLSGGLINSNSGQRMTVEEAVREGVIDRDTASSILTYQVQTGGIIQSNPAKRLTVDEAVQCDLITSSSALLVLEAQRGYVGLIWPHSGEIFPTSSSLQQELITNELAYKILNGRQKIAALYIPESSQVIGLDAAKQLGIIDNNTASILKNITLPDKMPDLGDLEACKNARRWLSFCKFQPSTVHDYRQEEDVFDGEEPVTTQTSEETKKLFLSYLMINSYMDANTGQRLLLYDGDLDEAVGMLLEGCHAEFDGNTAIKECLDVLSSSGVFLNNASGREKDECTATPSSFNKCHCGEPEHEETPENRKCAIDEEFNEMRNTVINSEFSQSGKLASTISIDPKVNSSPSVCVPSLISYLTQTELADISMLRSDSENILTNYENQSRVETNERANECSHSKNIQNFPSDLIENPIMKSKMSKFCGVNETENEDNTNRDSPIFDYSPRLSALLSHDKLMHSQGSFNDTHTPESNGNKCEAPALSFSDKTMLSGQRIGEKFQDQFLGIAAINISLPGEQYGQKSLNMISSNPQVQYHNDKYISNTSGEDEKTHPGFQQMPEDKEDESEIEEYSCAVTPGGDTDNAIVSLTCATPLLDETISASDYETSLLNDQQNNTGTDTDSDDDFYDTPLFEDDDHDSLLLDGDDRDCLHPEDYDTLQEENDETASPADVFYDVSKENENSMVPQGAPVGSLSVKNKAHCLQDFLMDVEKDELDSGEKIHLNPVGSDKVNGQSLETGSERECTNILEGDESDSLTDYDIVGGKESFTASLKFDDSGSWRGRKEEYVTGQEFHSDTDHLDSMQSEESYGDYIYDSNDQDDDDDDGIDEEGGGIRDENGKPRCQNVAEDMDIQLCASILNENSDENENINTMILLDKMHSCSSLEKQQRVNVVQLASPSENNLVTEKSNLPEYTTEIAGKSKENLLNHEMVLKDVLPPIIKDTESEKTFGPASISHDNNNISSTSELGTDLANTKVKLIQGSELPELTDSVKGKDEYFKNMTPKVDSSLDHIICTEPDLIGKPAEESHLSLIASVTDKDPQGNGSDLIKGRDGKSDILIEDETSIQKMYLGEGEVLVEGLVEEENRHLKLLPGKNTRDSFKLINSQFPFPQITNNEELNQKGSLKKATVTLKDEPNNLQIIVSKSPVQFENLEEIFDTSVSKEISDDITSDITSWEGNTHFEESFTDGPEKELDLFTYLKHCAKNIKAKDVAKPNEDVPSHVLITAPPMKEHLQLGVNNTKEKSTSTQKDSPLNDMIQSNDLCSKESISGGGTEISQFTPESIEATLSILSRKHVEDVGKNDFLQSERCANGLGNDNSSNTLNTDYSFLEINNKKERIEQQLPKEQALSPRSQEKEVQIPELSQVFVEDVKDILKSRLKEGHMNPQEVEEPSACADTKILIQNLIKRITTSQLVNEASTVPSDSQMSDSSGVSPMTNSSELKPESRDDPFCIGNLKSELLLNILKQDQHSQKITGVFELMRELTHMEYDLEKRGITSKVLPLQLENIFYKLLADGYSEKIEHVGDFNQKACSTSEMMEEKPHILGDIKSKEGNYYSPNLETVKEIGLESSTVWASTLPRDEKLKDLCNDFPSHLECTSGSKEMASGDSSTEQ

SEQ ID NO: 845 - protein, 777 aa, Homo sapiens
MPDNRQPRNRQPRIRSGNEPRSASAMEPDGRGAWAHSRAALDRLEKLLRCSRCTNILREPVCLGGCEHIFCSNCVSDYIGTGCPVCYTPAWIQDLKINRQLDSMIQLCSKLRNLLHDNELSDLKEDKPRKGLFNDAGNKKNSIKMWFSPRSKKVRYVVSKASVQTQPAIKKDASAQQDSYEFVSPSPPADVSERAKKASARSGKKQKKKTLAEINQKWNLEAEKEDGEFDSKEESKQKLVSFCSQPSVISSPQINGEIDLLASGSLTESECFGSLTEVSLPLAEQIESPDTKSRNEVVTPEKVCKNYLTSKKSLPLENNGKRGHHNRLSSPISKRCRTSILSTSGDFVKQTVPSENIPLPECSSPPSCKRKVGGTSGSKNSNMSDEFISLSPGTPPSTLSSSSYRRVMSSPSAMKLLPNMAVKRNHRGETLLHIASIKGDIPSVEYLLQNGSDPNVKDHAGWTPLHEACNHGHLKVVELLLQHKALVNTTGYQNDSPLHDAAKNGHVDIVKLLLSYGASRNAVNIFGLRPVDYTDDESMKSLLLLPEKNESSSASHCSVMNTGQRRDGPLVLIGSGLSSEQQKMLSGLAVILKAKKYTEFDSTVTHVVVPGDAVQSTLKCMLGILNGCWILKFEWVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVTSFELLPLDS

SEQ ID NO: 846 - protein, 3418 aa, Homo sapiens [sequence omitted]

SEQ ID NO: 847 - protein, 415 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKGCQGSRDACSPWEQVLAFAVAKTGCKLLQPQRNWPSSRGPPWRASEGERTAQ

SEQ ID NO: 848 - protein, 1863 aa, Homo sapiens [sequence omitted]

SEQ ID NO: 849 - protein, 233 aa, Homo sapiens
SVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 850 - protein, 158 aa, Homo sapiens
MSHGKGTDMLPEIAAAVGFLSSLLRTRGCVSEQRLKVFSGALQEALTEHYKHHWFPEKPSKGSGYRCIRINHKMDPIISRVASQIGLSQPQLHQLLPSELTLWVDPYEVSYRIGEDGSICVLYEEAPLAASCGLLTCKNQVLLGRSSPSKNYVMAVSS

SEQ ID NO: 851 - protein, 1761 aa, Homo sapiens
MADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSTPQSEGGTLKAVKSSKGKKKRESIEGKDGRRRKSASDSGCDPASKKLKGDRGEVDSNGSDGGEASRGPWKGGNASGEPGLDQRAKQPPSTFVPQINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 852 - protein, 2225 aa, Homo sapiens
MAALVLEDGSVLRGQPFGAAVSTAGEVVFQTGMVGYPEALTDPSYKAQILVLTYPLIGNYGIPPDEMDEFGLCKWFESSGIHVAALVVGECCPTPSHWSATRTLHEWLQQHGIPGLQGVDTRELTKKLREQGSLLGKLVQNGTEPSSLPFLDPNARPLVPEVSIKTPRVFNTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTPVETIELTEDRRAFAARMAEIGEHVAPSEAANSLEQAQAAAERLGYPVLVRAAFALGGLGSGFASNREELSALVAPAFAHTSQVLVDKSLKGWKEIEYEVVRDAYGNCVTVCNMENLDPLGIHTGESIVVAPSQTLNDREYQLLRQTAIKVTQHLGIVGECNVQYALNPESEQYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAEEPKEKSSRKVAEPELMGTPDGTCYPPPPVPRQASPQNLGTPGLLHPQTSPLLHSLVGQHILSVQQFTKDQMSHLFNVAHTLRMMVQKERSLDILKGKVMASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 853 - protein, 3312 aa, Homo sapiens
MMARRPPWRGLGERSTPILLLLLLSLFPLSQEELGGGGHQGWDPGLAATTGPRAHIGGGALALCPESSGVREDGGPGLGVREPIFVGLRGRRQSARNSRGPPEQPNEELGIEHGVQPLGSRERETGQGPGSVLYWRPEVSSCGRTGPLQRGSLSPGALSSGVPGSGNSSPLPSDFLIRHHGPKPVSSQRNAGTGSRKRVGTARCCGELWATGSKGQGERATTSGAERTAPRRNCLPGASGSGPELDSAPRTARTAPASGSAPRESRTAPEPAPKRMRSRGLFRCRFLPQRPGPRPPGLPARPEARKVTSANRARFRRAANRHPQFPQYNYQTLVPENEAAGTAVLRVVAQDPDAGEAGRLVYSLAALMNSRSLELFSIDPQSGLIRTAAALDRESMERHYLRVTAQDHGSPRLSATTMVAVTVADRNDHSPVFEQAQYRETLRENVEEGYPILQLRATDGDAPPNANLRYRFVGPPAARAAAAAAFEIDPRSGLISTSGRVDREHMESYELVVEASDQGQEPGPRSATVRVHITVLDENDNAPQFSEKRYVAQVREDVRPHTVVLRVTATDRDKDANGLVHYNIISGNSRGHFAIDSLTGEIQVVAPLDFEAEREYALRIRAQDAGRPPLSNNTGLASIQVVDINDHIPIFVSTPFQVSVLENAPLGHSVIHIQAVDADHGENARLEYSLTGVAPDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSVNEDRPMGSTIVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVSVYELTAYAVDRGVPPLRTPVSIQVMVQDVNDNAPVFPAEEFEVRVKENSIVGSVVAQITAVDPDEGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNQTSGELRLSRKLDNNRPLVASMLVTVTDGLHSVTAQCVLRVVIITEELLANSLTVRLENMWQERFLSPLLGRFLEGVAAVLATPAEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACARREGGYTCVCRPRFTGEDCELDTEAGRCVPGVCRNGGTCTDAPNGGFRCQCPAGGAFEGPRCEVAARSFPPSSFVMFRGLRQRFHLTLSLSFATVQQSGLLFYNGRLNEKHDFLALELVAGQVRLTYSTGESNTVVSPTVPGGLSDGQWHTVHLRYYNKPRTDALGGAQGPSKDKVAVLSVDDCDVAVALQFGAEIGNYSCAAAGVQTSSKKSLDLTGPLLLGGVPNLPENFPVSHKDFIGCMRDLHIDGRRVDMAAFVANNGTMAGCQAKLHFCDSGPCKNSGFCSERWGSFSCDCPVGFGGKDCQLTMAHPHHFRGNGTLSWNFGSDMAVSVPWYLGLAFRTRATQGVLMQVQAGPHSTLLCQLDRGLLSVTVTRGSGRASHLLLDQVTVSDGRWHDLRLELQEEPGGRRGHHVLMVSLDFSLFQDTMAVGSELQGLKVKQLHVGGLPPGSAEEAPQGLVGCIQGVWLGSTPSGSPALLPPSHRVNAEPGCVVTNACASGPCPPHADCRDLWQTFSCTCQPGYYGPGCVDACLLNPCQNQGSCRHLPGAPHGYTCDCVGGYFGHHCEHRMDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGAAVRLCDEAQGWLEPDLFNCTSPAFRELSLLLDGLELNKTALDTMEAKKLAQRLREVTGHTDHYFSQDVRVTARLLAHLLAFESHQQGFGLTATQDAHFNENLLWAGSALLAPETGDLWAALGQRAPGGSPGSAGLVRHLEEYAATLARNMELTYLNPMGLVTPNIMLSIDRMEHPSSPRGARRYPRYHSNLFRGQDAWDPHTHVLLPSQSPRPSPSEVLPTSSSIENSTTSSVVPPPAPPEPEPGISIIILLVYRTLGGLLPAQFQAERRGARLPQNPVMNSPVVSVAVFHGRNFLRGILESPISLEFRLLQTANRSKAICVQWDPPGLAEQHGVWTARDCELVHRNGSHARCRCSRTGTFGVLMDASPRERLEGDLELLAVFTHVVVAVSVAALVLTAAILLSLRSLKSNVRGIHANVAAALGVAELLFLLGIHRTHNQLVCTAVAILLHYFFLSTFAWLFVQGLHLYRMQVEPRNVDRGAMRFYHALGWGVPAVLLGLAVGLDPEGYGNPDFCWISVHEPLIWSFAGPVVLVIVMNGTMFLLAARTSCSTGQREAKKTSALTLRSSFLLLLLVSASWLFGLLAVNHSILAFHYLHAGLCGLQGLAVLLLFCVLNADARAAWMPACLGRKAAPEEARPAPGLGPGAYNNTALFEESGLIRITLGASTVSSVSSARSGRTQDQDSQRGRSYLRDNVLVRHGSAADHTDHSLQAHAGPTDLDVAMFHRDAGADSDSDSDLSLEEERSLSIPSSESEDNGRTRGRFQRPLCRAAQSERLLTHPKDVDGNDLLSYWPALGECEAAPCALQTWGSERRLGLDTSKDAANNNQPDPALTSGDETSLGRAQRQRKGILKNRLQYPLVPQTRGAPELSWCRAATLGHRAVPAASYGRIYAGGGTGSLSQPASRYSSREQLDLLLRRQLSRERLEEAPAPVLRPLSRPGSQECMDAAPGRLEPKDRGSTLPRRQPPRDYPGAMAGRFGSRDALDLGAPREWLSTLPPPRRTRDLDPQPPPLPLSPQRQLSRDPLLPSRPLDSLSRSSNSREQLDQVPSRHPSREALGPLPQLLRAREDSVSGPSHGPSTEQLDILSSILASFNSSALSSVQSSSTPLGPHTTATPSATASVLGPSTPRSATSHSISELSPDSEVPRSEGHS

SEQ ID NO: 854 - protein, 916 aa, Homo sapiens
MIPARLHRDYKGLVLLGILLGTLWETGCTQIRYSVPEELEKGSRVGDISRDLGLEPRELAERGVRIIPRGRTQLFALNPRSGSLVTAGRIDREELCMGAIKCQLNLDILMEDKVKIYGVEVEVRDINDNAPYFRESELEIKISENAATEMRFPLPHAWDPDIGKNSLQSYELSPNTHFSLIVQNGADGSKYPELVLKRALDREEKAAHHLVLTASDGGDPVRTGTARIRVMVLDANDNAPAFAQPEYRASVPENLALGTQLLVVNATDPDEGVNAEVRYSFRYVDDKAAQVFKLDCNSGTISTIGELDHEESGFYQMEVQAMDNAGYSARAKVLITVLDVNDNAPEVVLTSLASSVPENSPRGTLIALLNVNDQDSEENGQVICFIQGNLPFKLEKSYGNYYSLVTDIVLDREQVPSYNITVTATDRGTPPLSTETHISLNVADTNDNPPVFPQASYSAYIPENNPRGVSLVSVTAHDPDCEENAQITYSLAENTIQGASLSSYVSINSDTGVLYALSSFDYEQFRDLQVKVMARDNGHPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADSIPQVLADLGSLESPANSETSDLTLYLVVAVAAVSCVFLAFVILLLALRLRRWHKSRLLQASGGGLTGAPASHFVGVDGVQAFLQTYSHEVSLTTDSRKSHLIFPQPNYADMLVSQESFEKSEPLLLSGDSVFSKDSHGLIEVSLYQIFFLFFFNCSVSQAGVQRYDHSSLRPQTPRLKQLSHLCLRCNRDYRCKPPTVCLSIYLSIYLSIYLSIYLLLSCTDGSLTPVIPVLWEAEAGGSPEVGSLRPA

SEQ ID NO: 855 - protein, 1066 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRTRYYQIMPKYHAVRIREEERYPPPGSTLPTKKHWVTSWQTRDQYY

SEQ ID NO: 856 - protein, 195 aa, Homo sapiens
GSRSSHAAVIPDGDSIRRETGFSQASLLRLHHRFRALDRNKKGYLSRMDLQQIGALAVNPLGDRIIESFFPDGSQRVDFPGFVRVLAHFRPVEDEDTETQDPKKPEPLNSRRNKLHYAFQLYDLDRDGKISRHEMLQVLRLMVGVQVTEEQLENIADRTVQEADEDGDGAVSFVEFTKSLEKMDVEQKMSIRILK

SEQ ID NO: 857 - protein, 78 aa, Homo sapiens
MSEVLPYGDEKLSPYGDGGDVGQIFSCRLQDTNNFFGAGQNKRPPKLGQIGRSKRVVIEDDRIDDVLKNMTDKAPPGV

SEQ ID NO: 858 - protein, 702 aa, Homo sapiens
MVAHINNSRLKAKGVGQHDNAQNFGNQSFEELRAACLRKGELFEDPLFPAEPSSLGFKDLGPNSKNVQNISWQRPKDIINNPLFIMDGISPTDICQGILGDCWLLAAIGSLTTCPKLLYRVVPRGQSFKKNYAGIFHFQIWQFGQWVNVVVDDRLPTKNDKLVFVHSTERSEFWSALLEKAYAKLSGSYEALSGGSTMEGLEDFTGGVAQSFQLQRPPQNLLRLLRKAVERSSLMGCSIEVTSDSELESMTDKMLVRGHAYSVTGLQDVHYRGKMETLIRVRNPWGRIEWNGAWSDSAREWEEVASDIQMQLLHKTEDGEFWMSYQDFLNNFTLLEICNLTPDTLSGDYKSYWHTTFYEGSWRRGSSAGGCRNHPGTFWTNPQFKISLPEGDDPEDDAEGNVVVCTCLVALMQKNWRHARQQGAQLQTIGFVLYAVPKEFQNIQDVHLKKEFFTKYQDHGFSEIFTNSREVSSQLRLPPGEYIIIPSTFEPHRDADFLLRVFTEKHSESWELDEVNYAEQLQEEKVSEDDMDQDFLHLFKIVAGEGKEIGVYELQRLLNRMAIKFKSFKTKGFGLDACRCMINLMDKDGSGKLGLLEFKILWKKLKKWMDIFRECDQDHSGTLNSYEMRLVIEKAGIKLNNKVMQVLVARYADDDLIIDFDSFISCFLRLKTMFTFFLTMDPKNTGHICLSLEQWLQMTMWG

SEQ ID NO: 859 - protein, 906 aa, Homo sapiens
MTAVHAGNINFKWDPKSLEIRTLAVERLLEPLVTQVTTLVNTNSKGPSNKKRGRSKKAHVLAASVEQATENFLEKGDKIAKESQFLKEELVAAVEDVRKQGDLMKAAAGEFADDPCSSVKRGNMVRAARALLSAVTRLLILADMADVYKLLVQLKVVEDGILKLRNAGNEQDLGIQYKALKPEVDKLNIMAAKRQQELKDVGHRDQMAAARGILQKNVPILYTASQACLQHPDVAAYKANRDLIYKQLQQAVTGISNAAQATASDDASQHQGGGGGELAYALNNFDKQIIVDPLSFSEERFRPSLEERLESIISGAALMADSSCTRDDRRERIVAECNAVRQALQDLLSEYMGNAGRKERSDALNSAIDKMTKKTRDLRRQLRKAVMDHVSDSFLETNVPLLVLIEAAKNGNEKEVKEYAQVFREHANKLIEVANLACSISNNEEGVKLVRMSASQLEALCPQVINAALALAAKPQSKLAQENMDLFKEQWEKQVRVLTDAVDDITSIDDFLAVSENHILEDVNKCVIALQEKDVDGLDRTAGAIRGRAARVIHVVTSEMDNYEPGVYTEKVLEATKLLSNTVMPRFTEQVEAAVEALSSDPAQPMDENEFIDASRLVYDGIRDIRKAVLMIRTPEELDDSDFETEDFDVRSRTSVQTEDDQLIAGQSARAIMAQLPQEQKAKIAEQVASFQEEKSKLDAEVSKWDDSGNDIIVLAKQMCMIMMEMTDFTRGKGPLKNTSDVISAAKKIAEAGSRMDKLGRTIADHCPDSACKQDLLAYLQRIALYCHQLNICSKVKAEVQNLGGELVVSGVDSAMSLIQAAKNLMNAVVQTVKASYVASTKYQKSQGMASLNLPAVSWKMKAPEKKPLVKREKQDETQTKIKRASQKKHVNPVQALSEFKAMDSI

SEQ ID NO: 860 - protein, 1210 aa, Homo sapiens
RAMEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSSNSIKQRKPKLLLPPTESGSESSITILKGEILLLECFAEGLPTPQVDWNKIGGDLPKGREAKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPVEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 861 - protein, 490 aa, Homo sapiens
MEDSASASLSSAAATGTSTSTPAAPTARKQLDKEQVRKAVDALLTHCKSRKNNYGLLLNENESLFLMVVLWKIPSKELRVRLTLPHSIRSDSEDICLFTKDEPNSTPEKTEQFYRKLLNKHGIKTVSQIISLQTLKKEYKSYEAKLRLLSSFDFFLTDARIRRLLPSLIGRHFYQRKKVPVSVNLLSKNLSREINDCIGGTVLNISKSGSCSAIRIGHVGMQIEHIIENIVAVTKGLSEKLPEKWESVKLLFVKTEKSAALPIFSSFVSNWDEATKRSLLNKKKKEARRKRRERNFEKQKERKKKRQQARKTASVLSKDDVAPESGDTTVKKPESKKEQTPEHGKKKRGRGKAQVKATNESEDEIPQLVPIGKKTPANEKVEIQKHATGKKSPAKSPNPSTPRGKKRKALPASETPKAAESETPGKSPEKKPKIKEEAVKEKSPSLGKKDARQTPKKPEAKFFTTPSKSVRKASHTPKKWPKKPKVPQST

SEQ ID NO: 862 - protein, 3210 aa, Homo sapiens
MSWALEEWKEGLPTRTLQKIQELEGQLDKLKKEKQQRQFQLDSLEAAPQKQTQKVENEKTEGTNLKRENQRLMEICESLEKTKQKISHELQVKESQVNFQEGQLNSGKKQIEKLEQELKRCKSELERSQQAAQSADVSLNPCNTPQKIFTTPLTPSQYYSGSKYEDLKEKYNKEVEERKRLEAEVKALQAKKASQTLPQATMNHRDIARHQASSSVFSWQQEKTPSHLSSNSQRTPIRRDFSASYFSGELEVTPSRSTLQIGKRDANSSFFGNSSSPHLLDQLKAQNQELRNKINELELRLQGHEKEMKGQVNKFQELQLQLEKAKVELIEKEKVLNKCRDELVRTTAQYDQASTKYTALEQKLKKLTEDLSCQRQNAESARCSLEQKIKEKEKEFQEELSRQQRSFQTLDQECIQMKARLTQELQQAKNMHNVLQAELDKLTSVKQQLENNLEEFKQKLCRAEQAFQASQIKENELRRSMEEMKKENNLLKSHSEQKAREVCHLEAELKNIKQCLNQSQNFAEEMKAKNTSQETMLRDLQEKINQQENSLTLEKLKLAVADLEKQRDCSQDLLKKREHHIEQLNDKLSKTEKESKALLSALELKKKEYEELKEEKTLFSCWKSENEKLLTQMESEKENLQSKINHLETCLKTQQIKSHEYNERVRTLEMDRENLSVEIRNLHNVLDSKSVEVETQKLAYMELQQKAEFSDQKHQKEIENMCLKTSQLTGQVEDLEHKLQLLSNEIMDKDRCYQDLHAEYESLRDLLKSKDASLVTNEDHQRSLLAFDQQPAMHHSFANIIGEQGSMPSERSECRLEADQSPKNSAILQNRVDSLEFSLESQKQMNSDLQKQCEELVQIKGEIEENLMKAEQMHQSFVAETSQRISKLQEDTSAHQNVVAETLSALENKEKELQLLNDKVETEQAEIQELKKSNHLLEDSLKELQLLSETLSLEKKEMSSIISLNKREIEELTQENGTLKEINASLNQEKMNLIQKSESFANYIDEREKSISELSDQYKQEKLILLQRCEETGNAYEDLSQKYKAAQEKNSKLECLLNECTSLCENRKNELEQLKEAFAKEHQEFLTKLAFAEERNQNLMLELETVQQALRSEMTDNQNNSKSEAGGLKQEIMTLKEEQNKMQKEVNDLLQENEQLMKVMKTKHECQNLESEPIRNSVKERESERNQCNFKPQMDLEVKEISLDSYNAQLVQLEAMLRNKELKLQESEKEKECLQHELQTIRGDLETSNLQDMQSQEISGLKDCEIDAEEKYISGPHELSTSQNDNAHLQCSLQTTMNKLNELEKICEILQAEKYELVTELNDSRSECITATRKMAEEVGKLLNEVKILNDDSGLLHGELVEDIPGGEFGEQPNEQHPVSLAPLDESNSYEHLTLSDKEVQMHFAELQEKFLSLQSEHKILHDQHCQMSSKMSELQTYVDSLKAENLVLSTNLRNFQGDLVKEMQLGLEEGLVPSLSSSCVPDSSSLSSLGDSSFYRALLEQTGDMSLLSNLEGAVSANQCSVDEVFCSSLQTYVDSLKAENLVLSTNLRNFQGDLVKEMQLGLEEGLVPSLSSSCVPDSSSLSSLGDSSFYRALLEQTGDMSLLSNLEGVVSANQCSVDEVFCSSLQEENLTRKETPSAPAKGVEELESLCEVYRQSLEKLEEKMESQGIMKNKEIQELEQLLSSERQELDCLRKQYLSENEQWQQKLTSVTLEMESKLAAEKKQTEQLSLELEVARLQLQGLDLSSRSLLGIDTEDAIQGRNESCDISKEHTSETTERTPKHDVHQICDKDAQQDLNLDIEKITETGAVKPTGECSGEQSPDTNYEPPGEDKTQGSSECISELSFSGPNALVPMDFLGNQEDIHNLQLRVKETSNENLRLLHVIEDRDRKVESLLNEMKELDSKLHLQEVQLMTKIEACIELEKIVGELKKENSDLSEKLEYFSCDHQELLQRVETSEGLNSDLEMHADKSSREDIGDNVAKVNDSWKERFLDVENELSRIRSEKASIEHEALYLEADLEVVQTEKLCLEKDNENKQKVIVCLEEELSVVTSERNQLRGELDTMSKKTTALDQLSEKMKEKTQELESHQSECLHCIQVAEAEVKEKTELLQTLSSDVSELLKDKTHLQEKLQSLEKDSQALSLTKCELENQIAQLNKEKELLVKESESLQARLSESDYEKLNVSKALEAALVEKGEFALRLSSTQEEVHQLRRGIEKLRVRIEADEKKQLHIAEKLKERERENDSLKDKVENLERELQMSEENQELVILDAENSKAEVETLKTQIEEMARSLKVFELDLVTLRSEKENLTKQIQEKQGQLSELDKLLSSFKSLLEEKEQAEIQIKEESKTAVEMLQNQLKELNEAVAALCGDQEIMKATEQSLDPPIEEEHQLRNSIEKLRARLEADEKKQLCVLQQLKESEHHADLLKGRVENLERELEIARTNQEHAALEAENSKGEVETLKAKIEGMTQSLRGLELDVVTIRSEKEDLTNELQKEQERISELEIINSSFENILQEKEQEKVQMKEKSSTAMEMLQTQLKELNERVAALHNDQEACKAKEQNLSSQVECLELEKAQLLQGLDEAKNNYIVLQSSVNGLIQEVEDGKQKLEKKDEEISRLKNQIQDQEQLVSKLSQVEGEHQLWKEQNLELRNLTVELEQKIQVLQSKNASLQDTLEVLQSSYKNLENELELTKMDKMSFVEKVNKMTAKETELQREMHEMAQKTAELQEELSGEKNRLAGELQLLLEEIKSSKDQLKELTLENSELKKSLDCMHKDQVEKEGKVREEIAEYQLRLHEAEKKHQALLLDTNKQYEVEIQTYREKLTSKEECLSSQKLEIDLLKSSKEELNNSLKATTQILEELKKTKMDNLKYVNQLKKENERAQGKMKLLIKSCKQLEEEKEILQKELSQLQAAQEKQKTGTVMDTKVDELTTEIKELKETLEEKTKEADEYLDKYCSLLISHEKLEKAKEMLETQVAHLCSQQSKQDSRGSPLLGPVVPGPSPIPSVTEKRLSSGQNKASGKRQRSSGIWENGGGPTPATPESFSKKSKKAVMSGIHPAEDTEGTEFEPEGLPEVVKKGFADIPTGKTSPYILRRTTMATRTSPRLAAQKLALSPLSLGKENLAESSKPTAGGSRSQKVKVAQRSPVDSGTILREPTTKSVPVNNLPERSPTDSPREGLRVKRGRLVPSPKAGLESKGSENCKVQ

SEQ ID NO: 863 - protein, 1704 aa, Homo sapiens
MSSVSEVNVDIKDFLMSINLEQYLLHFHESGFTTVKDCAAINDSLLQKIGISPTGHRRRILKQLQIILSKMQDIPIYANVHKTKKNDDPSKDYHVPSSDQNICIELSNSGSVQTSSPPQLETVRKNLEDSDASVERSQYPQSDDKLSPPKRDFPTAEEPHLNLGSLNDSLFGSDNIKIESLITKKTVDHTVEEQQTEKVKLITENLSKLPNADSECLSFVGCSTSGTNSGNGTNGLLEGSPPSPFFKFQGEMIVNDLYVPSSPILAPVRSRSKLVSRPSRSFLLRHRPVPEIPGSTKGVSGSYFRERRNVATSTEKSVAWQNSNEENSSSIFPYGETFLFQRLENSKKRSIKNEFLTQGEALKGEAATATNSFIIKSSIYDNRKEKISEDKVEDIWIPREDKNNFLIDTASESEYSTVEECFQSLRRKNSKASKSRTQKALILDSVNRHSYPLSSTSGNADSSAVSSQAISPYACFYGASAKKVKSGWLDKLSPQGKRMFQKRWVKFDGLSISYYNNEKEMYSKGIIPLSAISTVRVQGDNKFEVVTTQRTFVFRVEKEEERNDWISILLNALKSQSLTSQSQAVVTPEKCGYLELRGYKAKIFTVLSGNSVWLCKNEQDFKSGLGITIIPMNVANVKQVDRTVKQSFEIITPYRSFSFTAETEKEKQDWIEAVQQSIAETLSDYEVAEKIWFNESNRSCADCKAPDPDWASINLCVVICKKCAGQHRSLGPKDSKVRSLKMDASIWSNELIELFIVIGNKRANDFWAGNLQKDEELHMDSPVEKRKNFITQKYKEGKFRKTLLASLTKEELNKALCAAVVKPDVLETMALLFSGADVMCATGDPVHSTPYLLAKKAGQSLQMEFLYHNKFSDFPQHDIHSEGVLSQESSQSTFLCDFLYQAPSAASKLSSEKKLLEETNKKWCVLEGGFLSYYENDKSTTPNGTININEVICLAIHKEDFYLNTGPIFIFEIYLPSERVFLFGAETSQAQRKWTEAIAKHFVPLFAENLTEADYDLIGQLFYKDCHALDQWRKGWFAMDKSSLHFCLQMQEVQGDRMHLRRLQELTISTMVQNGEKLDVLLLVEKGRTLYIHGHTKLDFTVWHTAIEKAAGTDGNALQDQQLSKNDVPIIVNSCIAFVTQYGLGCKYIYQKNGDPLHISELLESFKKDARSFKLRAGKHQLEDVTAVLKSFLSDIDDALLTKELYPYWISALDTQDDKERIKKYGAFIRSLPGVNRATLAAIIEHLYRVQKCSEINHMNAHNLALVFSSCLFQTKGQTSEEVNVIEDLINNYVEIFEVKEDQVKQMDIENSFITKWKDTQVSQAGDLLIEVYVERKEPDCSIIIRISPVMEAEELTNDILAIKNIIPTKGDIWATFEVIENEELERPLHYKENVLEQVLRWSSLAEPGSAYLVVKRFLTADTIKHCSDRSTLGSIKEGILKIKEEPSKILSGNKFQDRYFVLRDGFLFLYKDVKSSKHDKMFSLSSMKFYRGVKKKMKPPTSWGLTAYSEKHHWHLCCDSSQTQTEWMTSIFIAQHEYDIWPPAGKERKRSITKNPKIGGLPLIPIQHEGNATLARKNIESARAELERLRLSEKCDKESVDSSLKERASMVAHCLEHKDDKLRNRPRKHRSFNCLEDTEPEAPLGQPKGHKGLKTLRKTEDRNSKATLDSDHKLPSRVIEELNVVLQRSRTLPKELQDEQILK

SEQ ID NO: 864 - protein, 2442 aa, Homo sapiens
METRSPGLNNMKPQSLQLVLEEQVLALQQQMAENQAASWRKLKNSQEAQQRQATLVRKLQAKVLQYRSWCQELEKRLEATGGPIPQRWENVEEPNLDELLVRLEEEQQRCESLAEVNTQLRLHMEKADVVNKALREDVEKLTVDWSRARDELMRKESQWQMEQEFFKGYLKGEHGRLLSLWREVVTFRRHFLEMKSATDRDLMELKAEHVRLSGSLLTCCLRLTVGAQSREPNGSGRMDGREPAQLLLLLAKTQELEKEAHERSQELIQLKSQGDLEKAELQDRVTELSALLTQSQKQNEDYEKMIKALRETVEILETNHTELMEHEASLSRNAQEEKLSLQQVIKDITQVMVEEGDNIAQGSGHENSLELDSSIFSQFDYQDADKALTLVRSVLTRRRQAVQDLRQQLAGCQEAVNLLQQQHDQWEEEGKALRQRLQKLTGERDTLAGQTVDLQGEVDSLSKERELLQKAREELRQQLEVLEQEAWRLRRVNVELQLQGDSAQGQKEEQQEELHLAVRERERLQEMLMGLEAKQSESLSELITLREALESSHLEGELLRQEQTEVTAALARAEQSIAELSSSENTLKTEVADLRAAAVKLSALNEALALDKVGLNQQLLQLEEENQSVCSRMEAAEQARNALQVDLAEAEKRREALWEKNTHLEAQLQKAEEAGAELQADLRDIQEEKEEIQKKLSESRHQQEAATTQLEQLHQEAKRQEEVLARAVQEKEALVREKAALEVRLQAVERDRQDLAEQLQGLSSAKELLESSLFEAQQQNSVIEVTKGQLEVQIQTVTQAKEVIQGEVRCLKLELDTERSQAEQERDAAARQLAQAEQEGKTALEQQKAAHEKEVNQLREKWEKERSWHQQELAKALESLEREKMELEMRLKEQQTEMEAIQAQREEERTQAESALCQMQLETEKERVSLLETLLQTQKELADASQQLERLRQDMKVQKLKEQETTGILQTQLQEAQRELKEAARQHRDDLAALQEESSSLLQDKMDLQKQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQDELELTRRALEKERLHSPGATSTAELGSRGEQGVQLGEVSGVEAEPSPDGMEKQSWRQRLEHLQQAVARLEIDRSRLQRHNVQLRSTLEQVERERRKLKREAMRAAQAGSLEISKATASSPTQQDGRGQKNSDAKCVAELQKEVVLLQAQLTLERKQKQDYITRSAQTSRELAGLHHSLSHSLLAVAQAPEATVLEAETRRLDESLTQSLTSPGPVLLHPSPSTTQAASR

SEQ ID NO: 865 - protein, 2024 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRGALQGRQAALLALQHKADEAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSACLGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNVPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIHEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNRKETKNTWKNNCPFSADENYRPLAKTRQQNISMQRQENLRWVSELSYVEEKEQWQEQIQLKKQLDFSVSICQTLMQDQQTLSCLLQTLLTGPYSVMPSNVASPQVHFIMHQLNQCYTQLTWQQNNVQRLKQMLNELMRQRNQHPEKPGGKERGSSASHPPSPSLFCPFSFPTQPVNLFNIPGFTNFSSFAPGMNFSPLFPSNFGDFSQNISTPSEQQQPLARILSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPLQAKVFSRKNHEQLEKIIKCNRSTEISSETGSDFSMFEALQDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAGTTVNNLEETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVHWNEKPLVKMTKNNCPVKPSYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEMCEMQTEELAGNSETLKEPETVGAQSI

SEQ ID NO: 866 - protein, 111 aa, Homo sapiens [sequence omitted]

SEQ ID NO: 867 - protein, 529 aa, Homo sapiens
AAIKAVNSKAEVARAQAALAVNICAARGLQDVLRTNLGPKGTMKMLASGAGDIKLTKDGNVLLDEMQIQHPTASLIAKVATAQDDVTGDGTTSNVLIIGELLKQADLYISEGLHPRIIAEGFEAAKIKALEVLEEVKVTKEMKRKILLDVARTSLQTKVHAELADVLTEVVVDSVLAVRRPGYPIDLFMVEIMEMKHKLGTDTKLIQGLVLDHGARHPDMKKRVEDAFILICNVSLEYEKTEVNSGFFYKTAEEKEKLVKAERKFIEDRVQKIIDLKDKVCAQSNKGFVVINQKGIDPFSLDSLAKHGIVALRRAKRRNMERLSLACGGMAVNSFEDLTVDCLGHAGLVYEYTLGEEKFTFIEECVNPCSVTLLVKGPNKHTLTQVKDAIRDGLRAIKNAIEDGCMVPGAGAIEVAMAEALVTYKNSIKGRARLGVQAFADALLIIPKVLAQNAGYDPQETLVKVQAEHVESKQLVGVDLNTGEPMVAADAGVWDNYCVKKQLLHSCTVIATNILLVDEIMRAGMSSLK

SEQ ID NO: 868 - protein, 3174 aa, Homo sapiens
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLALKLSTNEDIITLQILAELSCLQIFIQDQKCNISEIKIEGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQVMENGRFAKYKYFTHVMINKTDMLMITRRGVLFVTKGTFGQLTCEWQYSFDEFTKEPFIVHGRRLRIEAKERVKSVFHAREFGKIINFKTPEDARWILTKLQEAREPSPSL

SEQ ID NO: 869 - protein, 1739 aa, Homo sapiens
MMRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECLARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDDVTGGKKPFRPEASGSSRDSLISQSHTSHNLHPQKPHLPASHGPQMHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDRYAKGCETPGANLCQELFLGRK

SEQ ID NO: 870 - protein, 622 aa, Homo sapiens
MNKLNFHNNRVMQDRRSVCIFLPNDESLNIIINVKILCHQLLVQVCDLLRLKDCHLFGLSVIQNNEHVYMELSQKLYKYCPKEWKKEASKVRQYEVTWGIDQFGPPMIIHFRVQYYVENGRLISDRAARYYYYWHLRKQVLHSQCVLREEAYFLLAAFALQADLGNFKRNKHYGKYFEPEAYFPSWVVSKRGKDYILKHIPNMHKDQFALTASEAHLKYIKEAVRLDDVAVHYYRLYKDKREIEASLTLGLTMRGIQIFQNLDEEKQLLYDFPWTNVGKLVFVGKKFEILPDGLPSARKLIYYTGCPMRSRHLLQLLSNSHRLYMNLQPVLRHIRKLEENEEKKQYRESYISDNLDLDMDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDEIEMLVDDPRDLEQMNEESLEVSPDMCIYITEDMLMSRKLNGHSGLIVKEIGSSTSSSSETVVKLRGQSTDSLPQTICRKPKTSTDRHSLSLDDIRLYQKDFLRIAGLCQDTAQSYTFGCGHELDEEGLYCNSCLAQQCINIQDAFPVKRTSKYFSLDLTHDEVPEFVV

SEQ ID NO: 871 - protein, 336 aa, Homo sapiens
GELMSRLLSENADLKKQVRLLKENQMLRRLLSQSCQEGGGHDLLPPRAHAYPEAGSPGSGGPDFGRFTSVADTPSQLQTSSLEDLLCSHAPLSSEDDTSPGCAAPSQAPFKAFLSPPEPHSHRGTDRKLSPLLSPLQDSLVDKTLLEPREMVRPKKVCFSESSLPTGDRTRRSYYLNEIQSFAGAEKDARVVGEIAFQLDRRILAYVFPGVTRLYGFTVANIPEKIEQTSTKSLDGSVDERKLRELTQRYLALSARLEKLGYSRDVHPAFSEFLINTYGILKQRPDLRANPLHSSPAALRKLVIDVVPPKFLGDSLLLLNCLCELSKEDGKPLFAW

SEQ ID NO: 872 - protein, 481 aa, Homo sapiens
MYDAERGWSLSFAGCGFLGFYHVGATRCLSEHAPHLLRDARMLFGASAGALHCVGVLSGIPLEQTLQVLSDLVRKARSRNIGIFHPSFNLSKFLRQGLCKCLPANVHQLISGKIGISLTRVSDGENVLVSDFRSKDEVVDALVCSCFIPFYSGLIPPSFRGVRYVDGGVSDNVPFIDAKTTITVSPFYGEYDICPKVKSTNFLHVDITKLSLRLCTGNLYLLSRAFVPPDLKVLGEICLRGYLDAFRFLEEKGICNRPQPGLKSSSEGMDPEVAMPSWANMSLDSSPESAALAVRLEGDELLDHLRLSILPWDESILDTLSPRLATALSEEMKDKGGYMSKICNLLPIRIMSYVMLPCTLPVESAIAIVQRLVTWLPDMPDDVLWLQWVTSQVFTRVLMCLLPASRSQMPVSSQQASPCTPEQDWPCWTPCSPKGCPAETKAEATPRSILRSSLNFFLGNKVPAGAEGLSTFPSFSLEKSL

SEQ ID NO: 873 - protein, 3174 aa, Homo sapiens; identical to SEQ ID NO: 868

SEQ ID NO: 874 - protein, 871 aa, Homo sapiens
MIKKFDKKDEESGSGSNPFQHLEKSAVLQEARIFNETPINPRRCLHILTKILYLLNQGEHFGTTEATEAFFAMTRLFQSNDQTLRRMCYLTIKEMATISEDVIIVTSSLTKDMTGKEDVYRGPAIRALCRITDGTMLQAIERYMKQAIVDKVSSVSSSALVSSLHMMKISYDVVKRWINEAQEAASSDNIMVQYHALGVLYHLRKNDRLAVSKMLNKFTKSGLKSQFAYCMLIRIASRLLKETEDGHESPLFDFIESCLRNKHEMVIYEAASAIIHLPNCTARELAPAVSVLQLFCSSPKPALRYAAVRTLNKVAMKHPSAVTACNLDLENLITDSNRSIATLAITTLLKTGSESSVDRLMKQISSFVSEISDEFKVVVVQAISALCQKYPRKHSVMMTFLSNMLRDDGGFEYKRAIVDCIISIVEENPESKEAGLAHLCEFIEDCEHTVLATKILHLLGKEGPRTPVPSKYIRFIFNRVVLENEAVRAAAVSALAKFGAQNESLLPSILVLLQRCMMDTDDEVRDRATFYLNVLQQRQMALNATYIFNGLTVSVPGMEKALHQYTLEPSEKPFDMKSIPLAMAPVFEQKAEITLVATKPEKLAPSRQDIFQEQLAAIPEFLNIGPLFKSSEPVQLTEAETEYFVRCIKHMFTNHIVFQFDCTNTLNDQLLEKVTVQMEPSDSYEVLSCIPAPSLPYNQPGICYTLVRLPDDDPTAVAGSFSCTMKFTVRDCDPNTGVPDEDGYDDEYVLEDLEVTVSDHIQKVLKPNFAAAWEEVGDTFEKEETFALSSTKTLEEAVNNIITFLGMQPCERSDKVPENKNSHSLYLAGIFRGGYDLLVRSRLALADGVTMQVTVRSKERTPVDVILASVG

SEQ ID NO: 875 - protein, 661 aa, Homo sapiens
MDLQQSTTITSLEKWCLDESLSGCRRHYSVKKKLKLIRVLGLFMGLVAISTVSFSISAFSETDTQSTGEASVVSGPRVAQGYHQRTLLDLNDKILDYTPQPPLSKEGESENSTDHAQGDYPKDIFSLEERRKGAIILHVIGMIYMFIALAIVCDEFFVPSLTVITEKLGISDDVAGATFMAAGGSAPELFTSLIGVFIAHSNVGIGTIVGSAVFNILFVIGMCALFSREILNLTWWPLFRDVSFYIVDLIMLIIFFLDNVIMWWESLLLLTAYFCYVVFMKFNVQVEKWVKQMINRNKVVKVTAPEAQAKPSAARDKDEPTLPAKPRLQRGGSSASLHNSLMRNSIFQLMIHTLDPLAEELGSYGKLKYYDTMTEEGRFREKASILHKIAKKKCHVDENERQNGAANHVEKIELPNSTSTDVEMTPSSDASEPVQNGNLSHNIEGAEAQTADEEEDQPLSLAWPSETRKQVTFLIVFPIVFPLWITLPDVRKPSSRKFFPITFFGSITWIAVFSYLMVWWAHQVGETIGISEEIMGLTILAAGTSIPDLITSVIVARKGLGDMAVSSSVGSNIFDITVGLPLPWLLYTVIHRFQPVAVSSNGLFCAIVLLFIMLLFVILSIALCKWRMNKILGFIMFGLYFVFLVVSVLLEDRILTCPVSI

SEQ ID NO: 876 - protein, 1071 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGLTMHASILAYMFNLVEEGKISTSLNPGNPVNNQIFLQEYVANLLKSAFPHLQDAQVKLFVTGLFSLNQDIPAFKEHLRDFLVQIKEFAGEDTSDLFLEEREIALRQADEEKHKRQMSVPGIFNPHEIPEEMCD

SEQ ID NO: 877 - protein, 3670 aa, Homo sapiens
MGIKSGFTFWNLVFLLTVSCVKGFIYTCGGTLKGLNGTIESPGFPYGYPNGANCTWVIIAEERNRIQIVFQSFALEEEYDYLSLYDGHPHPTNFRTRLTGFHLPPPVTSTKSVFSLRLTSDFAVSAHGFKVYYEELQSSSCGNPGVPPKGVLYGTRFDVGDKIRYSCVTGYILDGHPQLTCIANSVNTASWDFPVPICRAEDACGGTMRGSSGIISSPSFPNEYHNNADCTWTIVAEPGDTISLIFTDFQMEEKYDYLEIEGSEPPTIWLSGMNIPPPIISNKNWLRLHFVTDSNHRYRGFSAPYQGSSTLTHTTSTGELEEHNRTTTGAIAVASTPADVTVSSVTAVTIHRLSEEQRVQVTSLRNSGLDPNTSKDGLSPHPADTQSTRRRPRHAEQIERTKELAVVTHRVKKAIDFKSRGFKLFPGKDNSNKFSILNEGGIKTASNLCPDPGEPENGKRIGSDFSLGSTVQFSCDEDYVLQGAKSITCQRIAEVFAAWSDHRPVCKVKTCGSNLQGPSGTFTSPNFPFQYDSNAQCVWVITAVNTNKVIQINFEEFDLEIGYDTLTIGDGGEVGDPRTVLQVLTGSFVPDLIVSMSSQMWLHLQTDESVGSVGFKVNYKEIEKESCGDPGTPLYGIREGDGFSNRDVLRFECQFGFELIGEKSIVCQENNQWSANIPICIFPCLSNFTAPMGTVLSPDYPEGYGNNLNCIWTIISDPGSRIHLSFNDFDLESQFDFLAVKDGDSPESPILGTFTGAEVPSHLTSNSHILRLEFQADHSMSGRGFNITYNTFGHNECPDPGIPINARRFGDNFQLGSSISVICEEGFIKTQGTETITCILMDGKVMWSGLIPKCGAPCGGHFSAPSGVILSPGWPGYYKDSLNCEWVIEAEPGHSIKITFERFQTELNYDVLEVHDGPNLLSPLLGSYNGTQVPQFLFSSSNFIYLLFTTDNSRSNNGFKIHYESVTVNTYSCLDPGIPVHGRRYGHDFSIGSTVSFSCDSGYRLSHEEPLLCEKNHWWSHPLPTCDALCGGDVRGPSGTILSPGYPEFYPNSLNCTWTVDVTHGKGVQFNFHTFHLEDHHDYLLITENGSFTQPLARLTGSDLPPTINAGLYGNFRAQLRFISDFSISYEGFNITFSEYNLEPCEDPGIPQYGSRIGFNFGIGDTLTFSCSSGYRLEGTSEIICLGGGRRVWSAPLPRCVAECGASATNNEGILLSPNYPLNYENNHECIYSIQVQAGKGINISARTFHLAQGDVLKIYDGKDKTTHLLGAFTGASMRGLTLSSTSNQLWLEFNSDTEGTDEGFQLVYTSFELSHCEDPGIPQFGYKISDQGHFAGSTIIYGCNPGYTLHGSSLLKCMTGERRAWDYPLPSCIAECGGRFKGESSGRILSPGYPFPYDNNLRCMWMIEVDPGNIVSLQFLAFDTEASHDILRVWDGPPENDMLLKEISGSLIPEGIHSTLNIVTIQFDTDFYISKSGFAIQFSSSVATACRDPGVPMNGTRNGDGREPGDTVVFQCDPGYELQGEERITCIQVENRYFWQPSPPVCIAPCGGNLTGSSGFILSPNFPHPYPHSRDCDWTITVNADYVISLAFISFSIEPNYDFLYIYDGPDSNSPLIGSFQDSKLPERIESSSNTMHLAFRSDGSVSYTGFHLEYKAKLRESCFDPGNIMNGTRLGMDYKLGSTVTYYCDAGYVLQGYSTLTCIMGDDGRPGWNRALPSCHAPCGSRSTGSEGTVLSPNYPKNYSVGHNCVYSIAVPKEFVVFGQFVFFQTSLHDVVEVYDGPTQQSSLLSSLSGSHSGESLPLSSGNQITIRFTSVGPITAKGFHFVYQAVPRTSSTQCSSVPEPRFGRRIGNEFAVGSSVLFDCNPGYILHGSIAIRCETVPNSLAQWNDSLPTCIVPCGGILTKRKGTILSPGYPEPYDNNLNCVWKITVPEGAGIQVQVVSFATEHNWDSLDFYDGGDNNAPRLGSYSGTTIPHLLNSTSNNLYLNFQSDISVSAAGFHLEYTAIGLDSCPEPQTPSSGIKIGDRYMVGDVVSFQCDQGYSLQGHSHITCMPGPVRRWNYPIPICLAQCGGAMSDFSGVILSPGFPGNYPSSLDCTWTINLPIGFGVHLQFVNFSTETIHDYLEVRSGSSETSTVIGRLSGPQIPSSLFSTTHETSLYFHSDYSQNKQGFHIVYQAYQLQSCPDPRPFRNGFVIGNDFTVGQTISFECFPGYTLIGNSALTCLHGVSRNWNHPLPRCEALCGGNITAMNGTIYSPGYPDEYPNFQDCFWLVRVPPGNGIYINFTVLQTEPIYDFITVWDGPDQNSPQIGQFSGNTALESVYSTSNQILIKFHSDFTTSGFFVLSYHAYQLRVCQPPPPVPNAEILTEDDEFEIGDIIRYQCLPGFTLVGNAILTCRLGERLQMDGAPPVCQVLCPANELRLDSTGVILSPGYPDSYPNLQMCAWSISVEKGYNITMFVEFFQTEKEFDVLQVYDGPNIQSPVLISLSGDYSSAFNITSNGHEVFLQWSADHGNNKKGFRIRYIAFYCSTPESPPHGYIISQTGGQLNSVVRWACDRGFRLVGKSSAVCRKSSYGYHAWDAPVPACQAISCGIPKAPTNGGILTTDYLVGTRVTYFCNDGYRLSSKELTTAVCQSDGTWSNHNKTPRCVVVTCPSINSFILEHGRWRIVNGSHYEYKTKVVFSCDPGYHGLGPASIECLPNGTWSWRNERPYCQIISCGELPTPPNGNKIGTQTSYGSTAIFTCDLGFMLVGSAVRECLSSGLWSESETRCLAGHCGIPELIVNGQVIGENYGYRDTVVYQCNPGFRLIGSSVRICQQDHNWSGQLPSCVPVSCGHPGSPIYGRTSGNGFNFNDVVTFSCNIGYLMQGPTKAQCQANRQWSHPPPMCKVVNCSDPGIPANSKRESKIEHGNFTYGTVVFYDCNPGYFLFGSSVLICQPNGQWDKPLPECIMIDCGHPGVPPNAVLSGEKYTFGSTVHYSCTGKRSLLGQSSRTCQLNGHWSGSQPHCSGDATGTCGDPGTPGHGSRQESNFRTKSTVRYACDTGYILHGSEERTCLANGSWTGRQPECKAVQCGNPGTTANGKVFRIDGTTFSSSVIYSCMEGYILSGPSVRQCTANGTWSGTLPNCTIISCGDPGIPANGLRYGDDYVVGQNVSYMCQPGYTMELNGSRIRTCTINGTWSGVMPTCRAVTCPTPPQISNGRLEGTNFDWGFSISYICSPGYELSFPAVLTCVGNGTWSGEVPQCLPKFCGDPGIPAQGKREGKSFIYQSEVSFSCNFPFILVGSSTRICQADGTWSGSSPHCIEPTQTSCENPGVPRHGSQNNTFGFQVGSVVQFHCKKGHLLQGSTTRTCLPDLTWSGIQPECIPHSCKQPETPAHANVVGMDLPSHGYTLIYTCQPGFFLAGGTEHRVCRSDNTWTGKVPICEAGSKILVKDPRPALGTPSPKLSVPDDVFAQNYIWKGSYNFKGRKQPMTLTVTSFNASTGRVNATLSNSNMELLLSGVYKSQEARLMLRIYLIKVPAHASVKKMKEENWAMDGFVSAEPDGATYVFQGFIQGKDYGQFGLQRLGLNMSEGSNSSNQPHGTNSSSVAIAILVPFFALIFAGFGFYLYKQRTAPKTQYTGCSVHENNNGQAAFENPMYDTNAKSVEGKAVRFDPNLNTVCTMV

SEQ ID NO: 878 - protein, 1698 aa, Homo sapiens
MVGELRYREFRVPLGPGLHAYPDELIRQRVGHDGHPEYQIRWLILRRGDEGDGGSGQVDCKAEHILLWMSKDEIYANCHKMLGEDGQVIGPSQESAGEVGALDKSVLEEMETDVKSLIQRALRQLEECVGTIPPAPLLHTVHVLSAYASIEPLTGVFKDPRVLDLLMHMLSSPDYQIRWSAGRMIQALSSHDAGTRTQILLSLSQQEAIEKHLDFDSRCALLALFAQATLSEHPMSFEGIQLPQVPGRVLFSLVKRYLHVTSLLDQLNDSAAEPGAQNTSAPEELSGERGQLELEFSMAMGTLISELVQAMRWDQASDRPRSSARSPGSIFQPQLADVSPGLPAAQAQPSFRRSRRFRPRSEFASGNTYALYVRDTLQPGMRVRMLDDYEEISAGDEGEFRQSNNGVPPVQVFWESTGRTYWVHWHMLEILGFEEDIEDMVEADEYQGAVASRVLGRALPAWRWRPMTELYAVPYVLPEDEDTEECEHLTLAEWWELLFFIKKLDGPDHQEVLQILQENLDGEILDDEILAELAVPIELAQDLLLTLPQRLNDSALRDLINCHVYKKYGPEALAGNQAYPSLLEAQEDVLLLDAQAQAKDSEDAAKVEAKEPPSQSPNTPLQRLVEGYGPAGKILLDLEQALSSEGTQENKVKPLLLQLQRQPQPFLALMQSLDTPETNRTLHLTVLRILKQLVDFPEALLLPWHEAVDACMACLRSPNTDREVLQELIFFLHRLTSVSRDYAVVLNQLGARDAISKALEKHLGKLELAQELRDMVFKCEKHAHLYRKLITNILGGCIQMVLGQIEDHRRTHRPINIPFFDVFLRYLCQGSSVEVKEDKCWEKVEVSSNPHRASKLTDHNPKTYWESNGSAGSHYITLHMRRGILIRQLTLLVASEDSSYMPARVVVCGGDSTSSLHTELNSVNVMPSASRVILLENLTRFWPIIQIRIKRCQQGGIDTRIRGLEILGPKPTFWPVFREQLCRHTRLFYMVRAQAWSQDMAEDRRSLLHLSSRLNGALRQEQNFADRFLPDDEAAQALGKTCWEALVSPVVQNITSPDEDGISPLGWLLDQYLECQEAVFNPQSRGPAFFSRVRRLTHLLVHVEPCEAPPPVVATPRPKGRNRSHDWSSLATRGLPSSIMRNLTRCWRAVVEKQVNNFLTSSWRDDDFVPRYCEHFNILQNSSSELFGPRAAFLLALQNGCAGALLKLPFLKAAHVSEQFARHIDQQIQGSRIGGAQEMERLAQLQQCLQAVLIFSGLEIATTFEHYYQHYMADRLLGVVSSWLEGAVLEQIGPCFPNRLPQQMLQSLSTSKELQRQFHVYQLQQLDQELLKLEDTEKKIQVGLGASGKEHKSEKEEEAGAAAVVDVAEGEEEEEENEDLYYEGAMPEVSVLVLSRHSWPVASICHTLNPRTCLPSYLRGTLNRYSNFYNKSQSHPALERGSQRRLQWTWLGWAELQFGNQTLHVSTVQMWLLLYLNDLKAVSVESLLAFSGLSADMLNQAIGPLTSSRGPLDLHEQKDIPGGVLKIRDGSKEPRSRWDIVRLIPPQTYLQAEGEDGQNLEKRRNLLNCLIVRILKAHGDEGLHIDQLVCLVLEAWQKGPCPPRGLVSSLGKGSACSSTDVLSCILHLLGKGTLRRHDDRPQVLSYAVPVTVMEPHTESLNPGSSGPNPPLTFHTLQIRSRGVPYASCTATQSFSTFR

SEQ ID NO: 879 - protein, 351 aa, Homo sapiens
MTEMSFLSSEVLVGDLMSPFDPSGLGAEESLGLLDDYLEVAKHFKPHGFSSDKAKAGSSEWLAVDGLVSPSNNSKEDAFSGTDWMLEKMDLKEFDLDALLGIDDLETMPDDLLTTLDDTCDLFAPLVQETNKQPPQTVNPIGHLPESLTKPDQVAPFTFLQPLPLSPGVLSSTPDHSFSLELGSEVDITEGDRKPDYTAYVAMIPQCIKEEDTPSDNDSGICMSPESYLGSPQHSPSTRGSPNRSLPSPGVLCGSARPKPYDPPGEKMVAAKVKGEKLDKKLKKMEQNKTAATRYRQKKRAEQEALTGECKELEKKNEALKERADSLAKEIQYLKDLIEEVRKARGKKRVP

SEQ ID NO: 880 - protein, 162 aa, Homo sapiens
PSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVRKENQWCEEK

SEQ ID NO: 881 - protein, 465 aa, Homo sapiens
METGFPAIMYPGSFIGGWGEEYLSWEGPGLPDFVFQQQPVESEAMHCSNPKSGVVLATVARGPDACQILTRAPLGQDPPQRTVLGLLTANGQYRRTCGQGITRIRCYSGSENAFPPAGKKALPDCGVQEPPKQGFDIYMDELEQGDRDSCSVREGMAFEDVYEVDTGTLKSDLHFLLDFNTVSPMLVDSSLLSQSEDISSLGTDVINVTEYAEEIYQYLREAEIRHRPKAHYMKKQPDITEGMRTILVDWLVEVGEEYKLRAETLYLAVNFLDRFLSCMSVLRGKLQLVGTAAMLLASKYEEIYPPEVDEFVYITDDTYTKRQLLKMEHLLLKVLAFDLTVPTTNQFLLQYLRRQGVCVRTENLAKYVAELSLLEADPFLKYLPSLIAAAAFCLANYTVNKHFWPETLAAFTGYSLSEIVPCLSELHKAYLDIPHRPQQAIREKYKASKYLCVSLMEPPAVLLLQ

SEQ ID NO: 882 - protein, 707 aa, Homo sapiens
MAAAVAAAGRLGWLFAALCLGNAAGEAAPGPRVLGFCLEEDGAAGAGWVRGGAARDTPDATFLLRLFGPGFANSSWSWVAPEGAGCREEAASPAGEWRALLRLRLRAEAVRPHSALLAVRVEPGGGAAEEAAPPWALGLGAAGLLALAALARGLQLSALALAPAEVQVLRESGSEAERAAARRLEPARRWAGCALGALLLLASLAQAALAVLLYRAAGQRAVPAVLGSAGLVFLVGEVVPAAVSGRWTLALAPRALGLSRLAVLLTLPVALPVGQLLELAARPGRLRERVLELARGGGDPYSDLSKGVLRCRTVEDVLTPLEDCFMLDASTVLDFGVLASIMQSGHTRIPVYEEERSNIVDMLYLKDLAFVDPEDCTPLSTITRFYNHPLHFVFNDTKLDAVLEEFKRGKSHLAIVQKVNNEGEGDPFYEVLGLVTLEDVIEEIIRSEILDESEDYRDTVVKRKPASLMAPLKRKEEFSLFKVSDDEYKVTISPQLLLATQRFLSREVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPGVPVEGSPGRNPGV

SEQ ID NO: 883 - protein, 551 aa, Homo sapiens
MPSETPQAEVGPTGCPHLSGPHSAQGSLEKGLPGDKEAKEPLWIRPDAPSRCTWQLGRPASESPHHHTVPEKSPKILPDILKKIGDTPMIRINKIGKKFGLKCELLAKCEFFNAGGSVKDRISLRMIEDAERAGTLKPGDTIIEPTSGNTGIGLALTAAVRGYRCIIVMPEKMSSEKVDVLRALGAEIVRTPTNARFDSPESHVGVAWRLKNEIPNSHILDQYRNASNPLAHYDTTADEILRQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTMAVAVKAAQELQEGQRCVVILPDSVRNYMTKFLSDRWMLQKGFLKEEDLMEKKPWWWHLRVQELSLSAPLTVLPTVSCEHTIEILREKGFDQAPVVDEAGVILGMVTLGNMLSSLLAGKVQPSDQVGKVIYTQFKQIRLTDTLGRLSHILEMDHFALVVHEQIQYHSTGKSSQRQMVFGVVTAIDLLNFVAAQERDQK

SEQ ID NO: 884 - protein, 493 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 885 - protein, 482 aa, Homo sapiens
SIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKTTSGYAGGLSSAYGGLTSPGLSYSLGSSFGSGAGSSSFSRTSSSRAVVVKKIETRDGKLVSESSDVLPK

SEQ ID NO: 886 - protein, 562 aa, Homo sapiens
MPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQVRMDRSRMYDSLNMHSLENSLIDIMRAEHDPLKGRLSYPHPGTDNLLMLNGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 887 - protein, 614 aa, Homo sapiens
MSGYSSDRDRGRDRGFGAPRFGGSRAGPLSGKKFGNPGEKLVKKKWNLDELPKFEKNFYQEHPDLARRTAQEVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETKRRCDELTRKMRRDGWPAMGIHGDKSQQERDWVLNEFKHGKAPILIATDVASRGLDVEDVKFVINYDYPNSSEDYIHRIGRTARSTKTGTAYTFFTPNNIKQVSDLISVLREANQAINPKLLQLVEDRGSGRSRGRGGMKDDRRDRYSAGKRGGFNTFRDRENYDRGYSSLLKRDFGAKTQNGVYSAANYTNGSFGSNFVSAGIQTSFRTGNPTGTYQNGYDSTQQYGSNVPNMHNGMNQQAYAYPATAAAPMIGYPMPTGYSQ

SEQ ID NO: 888 - protein, 1865 aa, Homo sapiens
MTRWVPTKREEKYGVAFYNYDARGADELSLQIGDTVHILETYEGWYRGYTLRKKSKKGIFPASYIHLKEAIVEGKGQHETVIPGDLPLIQEVTTTLREWSTIWRQLYVQDNREMFRSVRHMIYDLIEWRSQILSGTLPQDELKELKKKVTAKIDYGNRILDLDLVVRDEDGNILDPELTSTISLFRAHEIASKQVEERLQEEKSQKQNIDINRQAKFAATPSLALFVNLKNVVCKIGEDAEVLMSLYDPVESKFISENYLVRWSSSGLPKDIDRLHNLRAVFTDLGSKDLKREKISFVCQIVRVGRMELRDNNTRKLTSGLRRPFGVAVMDVTDIINGKVDDEDKQHFIPFQPVAGENDFLQTVINKVIAAKEVNHKGQGLWVTLKLLPGDIHQIRKEFPHLVDRTTAVARKTGFPEIIMPGDVRNDIYVTLVQGDFDKGSKTTAKNVEVTVSVYDEDGKRLEHVIFPGAGDEAISEYKSVIYYQVKQPRWFETVKVAIPIEDVNRSHLRFTFRHRSSQDSKDKSEKIFALAFVKLMRYDGTTLRDGEHDLIVYKAEAKKLEDAATYLSLPSTKAELEEKGHSATGKSMQSLGSCTISKDSFQISTLVCSTKLTQNVDLLGLLKWRSNTSLLQQNLRQLMKVDGGEVVKFLQDTLDALFNIMMENSESETFDTLVFDALVFIIGLIADRKFQHFNPVLETYIKKHFSATLAYTKLTKVLKNYVDGAEKPGVNEQLYKAMKALESIFKFIVRSRILFNQLYENKGEADFVESLLQLFRSINDMMSSMSDQTVRVKGAALKYLPTIVNDVKLVFDPKELSKMFTEFILNVPMGLLTIQKLYCLIEIVHSDLFTQHDCREILLPMMTDQLKYHLERQEDLEACCQLLSHILEVLYRKDVGPTQRHVQIIMEKLLRTVNRTVISMGRDSELIGNFVACMTAILRQMEDYHYAHLIKTFGKMRTDVVDFLMETFIMFKNLIGKNVYPFDWVIMNMVQNKVFLRAINQYADMLNKKFLDQANFELQLWNNYFHLAVAFLTQESLQLENFSSAKRAKILNKYGDMRRQIGFEIRDMWYNLGQHKIKFIPEMVGPILEMTLIPETELRKATIPIFFDMMQCEFHSTRSFQMFENEIITKLDHEVEGGRGDEQYKVLFDKILLEHCRKHKYLAKTGETFVKLVVRLMERLLDYRTIMHDENKENRMSCTVNVLNFYKEIEREEMYIRYLYKLCDLHKECDNYTEAAYTLLLHAKLLKWSEDVCVAHLTQRDGYQATTQGQLKEQLYQEIIHYFDKGKMWEEAIALGKELAEQYENEMFDYEQLSELLKKQAQFYENIVKVIRPKPDYFAVGYYGQGFPTFLRGKVFIYRGKEYERREDFEARLLTQFPNAEKMKTTSPPGDDIKNSPGQYIQCFTVKPKLDLPPKFHRPVSEQIVSFYRVNEVQRFEYSRPIRKGEKNPDNEFANMWIERTIYTTAYKLPGILRWFEVKSVFMVEISPLENAIETMQLTNDKINSMVQQHLDDPSLPINPLSMLLNGIVDPAVMGGFANYEKAFFTDRYLQEHPEAHEKIEKLKDLIAWQIPFLAEGIRIHGDKVTEALRPFHERMEACFKQLKEKVEKEYGVRIMPSSLDDRRGSRPRSMVRSFTMPSSSRPLSVASVSSLSSDSTPSRPGSDGFALEPLLPKKMHSRSQDKLDKDDLEKEKKDKKKEKRNSKHQEIFEKEFKPTDISLQQSEAVILSETISPLRPQRPKSQVMNVIGSERRFSVSPSSPSSQQTPPPVTPRAKLSFSMQSSLELNGMTGADVADVPPPLPLKGSVADYGNLMENQDLLGSPTPPPPPPHQRHLPPPLPSKTPPPPPPKTTRKQTSVDSGIVQ

SEQ ID NO: 889 - protein, 1006 aa, Homo sapiens
MPDQISVSEFVAETHEDYKAPTASSFTTRTAQCRNTVAAIEEALDVDRMVLYKMKKSVKAINSSGLAHVENEEQYTQALEKFGGNCVCRDDPDLGSAFLKFSVFTKELTALFKNLIQNMNNIISFPLDSLLKGDLKGVKGDLKKPFDKAWKDYETKITKIEKEKKEHAKLHGMIRTEISGAEIAEEMEKERRFFQLQMCEYLLKVNEIKIKKGVDLLQNLIKYFHAQCNFFQDGLKAVESLKPSIETLSTDLHTIKQAQDEERRQLIQLRDILKSALQVEQKEDSQIRQSTAYSLHQPQGNKEHGTERNGSLYKKSDGIRKVWQKRKCSVKNGFLTISHGTANRPPAKLNLLTCQVKTNPEEKKCFDLISHDRTYHFQAEDEQECQIWMSVLQNSKEEALNNAFKGDDNTGENNIVQELTKEIISEVQRMTGNDVCCDCGAPDPTWLSTNLGILTCIECSGIHRELGVHYSRMQSLTLDVLGTSELLLAKNIGNAGFNEIMECCLPAEDSVKPNPGSDMNARKDYITAKYIERRYARKKHADNAAKLHSLCEAVKTRDIFGLLQAYADGVDLTEKIPLANGHEPDETALHLAVRSVDRTSLHIVDFLVQNSGNLDKQTGKGSTALHYCCLTDNAECLKLLLRGKASIEIANESGETPLDIAKRLKHEHCEELLTQALSGRFNSHVHVEYEWRLLHEDLDESDDDMDEKLQPSPNRREDRPISFYQLGSNQLQSNAVSLARDAANLAKEKQRAFMPSILQNETYGALLSGSPPPAQPAAPSTTSAPPLPPRNVGKVQTASSANTLWKTNSVSVDGGSRQRSSSDPPAVHPPLPPLRVTSTNPLTPTPPPPVAKTPSVMEALSQPSKPAPPGISQIRPPPLPPQPPSRLPQKKPAPGADKSTPLTNKGQPRGPVDLSATEALGPLSNAMVLQPPAPMPRKSQATKLKPKRVKALYNCVADNPDELTFSEGDVIIVDGEEDQEWWIGHIDGDPGRKGAFPVSFVHFIAD

SEQ ID NO: 890 - protein, 2555 aa, Homo sapiens
MTAITHGSPVGGNDSQGQVLDGQSQHLFQQNQTSSPDSSNENSVATPPPEEQGQGDAPPQHEDEEPAFPHTELANLDDMINRPRWVVPVLPKGELEVLLEAAIDLSVKGLDVKSEACQRFFRDGLTISFTKILMDEAVSGWKFEIHRCIINNTHRLVELCVAKLSQDWFPLLELLAMALNPHCKFHIYNGTRPCELISSNAQLPEEELFARSSDPRSPKGWLVDLINKFGTLNGFQILHDRFFNGSALNIQIIAALIKPFGQCYEFLSQHTLKKYFIPVIEIVPHLLENLTDEELKKEAKNEAKNDALSMIIKSLKNLASRISGQDETIKNLEIFRLKMILRLLQISSFNGKMNALNEINKVISSVSYYTHRHSNPEEEEWLTAERMAEWIQQNNILSIVLQDSLHQPQYVEKLEKILRFVIKEKALTLQDLDNIWAAQAGKHEAIVKNVHDLLAKLAWDFSPGQLDHLFDCFKASWTNASKKQREKLLELIRRLAEDDKDGVMAHKVLNLLWNLAQSDDVPVDIMDLALSAHIKILDYSCSQDRDAQKIQWIDHFIEELRTNDKWVIPALKQIREICSLFGEASQNLSQTQRSPHIFYRHDLINQLQQNHALVTLVAENLATYMNSIRLYAGDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCRERKLIAKRRSYMMDDLELIGLDYLWRVVIQSSDEIANRAIDLLKEIYTNLGPRLKANQVVIHEDFIQSCFDRLKASYDTLCVFDGDKNSINCARQEAIRMVRVLTVIKEYINECDSDYHKERMILPMSRAFCGKHLSLIVRFPNQGRQVDELDIWFHTNDTIGSVRRCIVNRIKANVAHKKIELFVGGELIDSENDRKLIGQLNLKDKSLITAKLTQINFNMPSSPDSSSDSSTASPGNHRNHYNDGPNLKVESCLPGVIMSVHPKYISFLWQFANLGSNLNMPPLKNGARVLMKLMPPDRTAVEKLRTVCLDHANLGEGKLSPPLDSLFFGPSASQVLYLTEVVYALLMPAGVPLTDGSSDFQVHFLKSGGLPLVLSMLIRNNFLPNTDMETRRGAYLNALKIAKLLLTAIGYGHVRAVAEACQPVVDGTDPITQINQVTHDQAVVLQSALQSIPNPSSECVLRNESILLAQEISNEASRYMPDICVIRAIQKIIWASACGALGLFFSPNEEITKIYQMTTNGSNKLEVEDEQVCCEALEVMTLCFALLPTALDALSKEKAWQTFIIDLLLHCPSKTVRQLAQEQFFLMCTRCCMGHRPLLFFITLLFTILGSTAREKGKYSGDYFTLLRHLLNYAYNGNINIPNAEVLLVSEIDWLKRIRDNVKNTGETGVEEPILEGHLGVTKELLAFQTSEKKYHFGCEKGGANLIKELIDDFIFPASKVYLQYLRSGELPAEQAIPVCSSPVTINAGFELLVALAIGCVRNLKQIVDCLTEMYYMGTAITTCEALTEWEYLPPVGPRPPKGFVGLKNAGATCYMNSVIQQLYMIPSIRNSILAIEGTGSDLHDDMFGDEKQDSESNVDPRDDVFGYPHQFEDKPALSKTEDRKEYNIGVLRHLQVIFGHLAASQLQYYVPRGFWKQFRLWGEPVNLREQHDALEFFNSLVDSLDEALKALGHPAILSKVLGGSFADQKICQGCPHRFECEESFTTLNVDIRNHQNLLDSLEQYIKGDLLEGANAYHCEKCDKKVDTVKRLLIKKLPRVLAIQLKRFDYDWERECAIKFNDYFEFPRELDMGPYTVAGVANLERDNVNSENELIEQKEQSDNETAGGTKYRLVGVLVHSGQASGGHYYSYIIQRNGKDDQTDHWYKFDDGDVTECKMDDDEEMKNQCFGGEYMGEVFDHMMKRMSYRRQKRWWNAYIPFYEQMDMIDEDDEMIRYISELTIARPHQIIMSPAIERSVRKQNVKFMHNRLQYSLEYFQFVKKLLTCNGVYLNPAPGQDYLLPEAEEITMISIQLAARFLFTTGFHTKKIVRGPASDWYDALCVLLRHSKNVRFWFTHNVLFNVSNRFSEYLLECPSAEVRGAFAKLIVFIAHFSLQDGSCPSPFASPGPSSQACDNLSLSDHLLRATLNLLRREVSEHGHHLQQYFNLFVMYANLGVAEKTQLLKLNVPATFMLVSLDEGPGPPIKYQYAELGKLYSVVSQLIRCCNVSSTMQSSINGNPPLPNPFGDLNLSQPIMPIQQNVLDILFVRTSYVKKIIEDCSNSEDTIKLLRFCSWENPQFSSTVLSELLWQVAYSYTYELRPYLDLLFQILLIEDSWQTHRIHNALKGIPDDRDGLFDTIQRSKNHYQKRAYQCIKCMVALFSSCPVAYQILQGNGDLKRKWTWAVEWLGDELERRPYTGNPQYSYNNWSPPVQSNETANGYFLERSHSARMTLAKACELCPEEEPDDQDAPDEHEPSPSEDAPLYPHSPASQYQQNNHVHGQPYTGPAAHHLNNPQKTGQRTQENYEGNEEVSSPQMKDQ

SEQ ID NO: 891 - protein, 713 aa, Homo sapiens
MDDPKKEDILLLADEKFDFDLSLSSSSANEDDEVFFGPFGHKERCIAASLELNNPVPEQPPLPTSESPFAWSPLAGEKFVEVYKEAHLLALHIESSSRNQAAQAAKPEDPRSQGVERFIQESKLKINLFEKEKEMKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVDVSELAAEQLTAPPSASPTQPQTPEGGGQWLNSSCAWSESSQLNKTRSIRRRDSCLNSKTKVMPTPTNQFKIPKFSIGDSPDSSTPKLSRAQRPQSCTSVGRVTVHSTPVRRSSGPAPQSLLSARRVSALPTPASRRCSGLPPMTPKTMPRAVGSPLCVPARRRSSEPRKNSAMRTEPTRESNRKTDSRLVDVSPDRGSPPSRVPQALNFSPEESDSTFSKSTATEVAREEAKPGGDAAPSEALLVDIKLEPLAVTPDAASQPLIDLPLIDFCDTPEAHVAVGSESRPLIDLMTNTPDMNKNVAKPSPVVGQLIDLSSPLIQLSPEADKENV

SEQ ID NO: 892 - protein, 191 aa, Homo sapiens
MYVCLCVSVAKVTMADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 893 - protein, 629 aa, Homo sapiens
MAISPRSDATFSSQKSTPSESPRTKKFPLTEEEIFYMNCRAAYLTVFKSSLENIISKDQLYLALQHAGRNPSQKTINKYWTPQTAKLNFDDFCIILRKEKPTSKAELLKSFKQLDVNDDGCILHTDLYKFLTKRGEKMTREEVNAIINLADVNADGKFDYIKFCKLYMTTNEQCLKTTLEKLEVDSKLMRHQFGNHIEGSPERDPSPVPKPSPKITRKTDPETFLNKGDTRSSLLSATRKFKTSVSFIVTMGANGNRNSKLTEPNLIKDWQHMQSKGCFFLEEDGEIISHQYRMQIAQRSMVYLTIKPLNLSQVEGKPSPWLSVDTALYILKENESQANLQLVCFTELRNREVFGWTGELGPGIYWLIPSTTGCKLRKKIKPVTDEAQLVYRDETGELFLTKEFKSTLSDIFEVIDLDGNGLLSLEEYNFFELRTSGEKCDEDAWAVCRENFDTKRNELTRQGFMDLNLMEANDREGDPCDLWVTLHSMGYNKALELTEACPFVIDIYAEKCKPKIKAVHMEACSGQLEKAICKSVLSNGDAKVMDGYENIIVHTYSCDTWITSVIENKSDEKVIIHISNELSKNCINNRGLNIFAVEVGPKSTMVCQHVMPLNERQEWIYYCIYSLIS

SEQ ID NO: 894 - protein, 2649 aa, Homo sapiens
MAVWEAEQLGGLQRGDLLTPPAPDGDGRTAPLGQPPGAQLYCPACLVTCHSQEAFENHCASSEHAQMVAFDQALPWEHRSPPPGLSKFELCPKPDLCEYGDACTKAHSAQELQEWVRRTQAVELRGQAAWQDGLVPYQERLLAEYQRSSSEVLVLAETLDGVRVTCNQPLMYQAQERKTQYSWTFAVHSEEPLLHAALLKQEPGADFSLVAPGLPPGRLYARGERFRVPSSTADFQVGVRVQAASFGTFEQWVVFDFGRRPVLLQKLGLQLGQGRRPGPCRNLALGHPEEMERWHTGNRHVVPGVERTAEQTALMAKYKGPALALESNHSSVASGPISPTNYRQRMHQFLYEEEAAQQQLVAKLTLRGQVFLKTALQTPALNMLFAPPGALYAEVPVPSSLMPDTDQGFLLGRAVSTALVAPVPAPDNTVFEVRLERRASSGQALWLLLPARCCLALGLQPEARLVLEVQFQIDPMTFRLWHQAVDTLPEEQLVVPDLPTCALPRPWSVPPLRRGNRKQELAVALIAGWGPGDGRRVPPLLIYGPFGTGKTYTLAMASLEVIRRPETKVLICTHTNSAADIYIREYFHSHVSGGHPEATPLRVMYTDRPLSQTDPVTLQYCCLTDDRQAFRPPTRAELARHRVVVTTTSQARELRVPVGFFSHILIDEAAQMLECEALTPLAYASHGTRLVLAGDHMQVTPRLFSVARARAAEHTLLHRLFLCYQQETHEVARQSRLVFHENYRCTDAIVSFISRHFYVAKGNPIHARGKVPPHPRHYPLMFCHVAGNPDRDMSMASWLNLAEIAQVVEKVQEAYNTWPSCWGGREQRCICVVSHGAQVSALRQELRRRDLGQVSVGSFEILPGRQFRVVVLSTVHTCQSLLSPGALAPEFFTDARVLNTVLTRAQSQLVVVGDAVALCSFGACGKLWESFIRECVERHSVCPEGLSMEQVEQGVAQRRRWPPRGTQAGAAGNWEAAPEPVGDLAEEQAAVVTAMVKAEPGDEALSPASRDITATTAQTEAAAAPAGDAVKEDVVPGACAAGAAAAAGVESTEAEDAEADFWPWDGELNADDAILRELLDESQKVMVTVGEDGLLDTVARPESLQQARLYENLPPAALRKLLRAEPERYRHCSFVPETFERASAIPLDDASSGPIQVRGRLDCGMAFAGDEVLVQLLSGDKAPEGRLRGRVLGVLKRKRHELAFVCRMDTWDPRIMVPINGSVTKIFVAELKDPSQVPIYSLRKGRLQRVGLERLTAEARHSRLFWVQIVLWRQGFYYPLGIVREVLPEASTWEQGLRILGLEYSLRVPPSDQATITKVLQKYHTELGRVAGRREDCRAFLTFTVDPQGACNLDDALSVRDLGPRCEVAVHITDVASFVPRDGVLDVEARRQGAAFYAPGREPVPMLPASLCQDVLSLLPGRDRLAISLFLTMEKASGQLKSLRFAPSVVQSDRQLSYEEAEEVIRQHPGAGRELPARLDSVDACVVAACYFSRLLRRHRLRSDCFYEQPDEDGTLGFRAAHIMVKEYMIQFNRLVAEFLVGSECTRTVTPLRWQPAPRSQQLKALCEKHGDRVPLSLHLGHHLHGGGGSPPDTRLHLLASLWKQVQFAARTQDYEQMVDLVTTDDMHPFLAPAGRDLRKALERSAFGRCARGHQQQGGHYSLQVDWYTWATSPIRRYLDVVLQRQILLALGHGGSAYSARDIDGLCQAFSLQHALAQSYQRRARSLHLAVQLKAQPLDKLGFVVDVEAGSRCFRLLFPSNRETLPDPCPVPYGSLQLAEHPHALAGRPGLRLLWRRRVYSAQGSSPPLPLPGTVPDPHTLAVETALWKQLLELVELQRWPEAAALIQEKGEASQRRELVQVQRSHCGHFLEVARELGSGDTLQVQLGTSLQHGFLVPSPQLWTVAPGFSLCLEHVERPGDCFSGRVYRAPRDRYRDVDEYACVWEPFCALESATGAVAENDSVTLQHLSVSWEASRTPQGQLQGAFRLEAAFLEENCADINFSCCYLCIRLEGLLAPTASPRPGPSSLGPGLNVDPGTYTWVAHGQTEDWDQERRADRQEAPRRVHLFVHHMGMEKVPEEVLRPGTLFTVELLPKQLPDLRKEEAVRGLEEASPLVTSIALGRPVPQPLCRVIPSRFLERQTYNIPGGRHKLNPSQNVAVREALEKPFTVIQGPPGTGKTIVGLHIVFWFHKSNQEQVQPGGPPRGEKRLGGPCILYCGPSNKSVDVLAGLLLRRMELKPLRVYSEQAEASEFPVPRVGSRKLLRKSPREGRPNQSLRSITLHHRIRQAPNPYSSEIKAFDTRLQRGELFSREDLVWYKKVLWEARKFELDRHEVILCTCSCAASASLKILDVRQILVDEAGMATEPETLIPLVQFPQAEKVVLLGDHKQLRPVVKNERLQNLGLDRSLFERYHEDAHMLDTQYRMHEGICAFPSVAFYKSKLKTWQGLRRPPSVLGHAGKESCPVIFGHVQGHERSLLVSTDEGNENSKANLEEVAEVVRITKQLTLGRTVEPQDIAVLTPYNAQASEISKALRREGIAGVAVSSITKSQGSEWRYVLVSTVRTCAKSDLDQRPTKSWLKKFLGFVVDPNQVNVAVTRAQEGLCLIGDHLLLRCCPLWRSLLDFCEAQQTLVPAGQVRVCRRPTMPS

SEQ ID NO: 895 - protein, 370 aa, Homo sapiens
GTWHSPSCRTQSGVQLSGSKRTADDSFGSLRGLSAQQTPSPPRRSSPGRGRSPRRGPSPACSDSSTLALIHSTLHKHELQVQDMRGRYEASQDLLGTLRKQLSDSESERRALEEQLQRLRDKTDSTMQAHEDAQREVQRLRSAKELLRREKSNLAHSLQVAQQQAKELRQERKKLQAAQEELRRQRYWLGEEQEDAVQDGVRVRRELERSHRQLEQLEGKRSVLAKELVEVREALSRATLQRDMLQAEKAEVAEALTKAEGRGGLPAGLPVQAERPQREPCSGQVGSEPPCHPGHSWRKKSAPCRAGSGRRSRRPQWHGKSRSGWRRCGWNRRWRGRAWRAPYERRSRPRRQWSSSSPRCIMSAAGCRSS

SEQ ID NO: 896 - protein, 1087 aa, Homo sapiens
MSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 897 - protein, 1140 aa, Homo sapiens [sequence omitted]

SEQ ID NO: 898 - protein, 1493 aa, Homo sapiens
MPNEGIPHSSQTQEQDCLQSQPVSNNEEMAIKQESGGDGEVEEYLSFRSVGDGLSTSAVGCASAAPRRGPALLHIDRHQIQAVEPSAQALELQGLGVDVYDQDVLEQGVLQQVDNAIHEASRASQLVDVEKEYRSVLDDLTSCTTSLRQINKIIEQLSPQAATSRDINRKLDSVKRQKYNKEQQLKKITAKQKHLQAILGGAEVKIELDHASLEEDAEPGPSSLGSMLMPVQETAWEELIRTGQMTPFGTQIPQKQEKKPRKIMLNEASGFEKYLADQAKLSFERKKQGCNKRAARKAPAPVTPPAPVQNKNKPNKKARVLSKKEERLKKHIKKLQKRALQFQGKVGLPKARRPWESDMRPEAEGDSEGEESEYFPTEEEEEEEDDEVEGAEADLSGDGTDYELKPLPKGGKRQKKVPVQEIDDDFFPSSGEEAEAASVGEGGGGGRKVGRYRDDGDEDYYKQRLRRWNKLRLQDKEKRLKLEDDSEESDAEFDEGFKVPGFLFKKLFKYQQTGVRWLWELHCQQAGGILGDEMGLGKTIQIIAFLAGLSYSKIRTRGSNYRFEGLGPTVIVCPTTVMHQWVKEFHTWWPPFRVAILHETGSYTHKKEKLIRDVAHCHGILITSYSYIRLMQDDISRYDWHYVILDEGHKIRNPNAAVTLACKQFRTPHRIILSGSPMQNNLRELWSLFDFIFPGKLGTLPVFMEQFSVPITMGGYSNASPVQVKTAYKCACVLRDTINPYLLRRMKSDVKMSLSLPDKNEQVLFCRLTDEQHKVYQNFVDSKEVYRILNGEMQIFSGLIALRKICNHPDLFSGGPKNLKGLPDDELEEDQFGYWKRSGKMIVVESLLKIWHKQGQRVLLFSQSRQMLDILEVFLRAQKYTYLKMDGTTTIASRQPLITRYNEDTSIFVFLLTTRVGGLGVNLTGANRVVIYDPDWNPSTDTQARERAWRIGQKKQVTVYRLLTAGTIEEKIYHRQIFKQFLTNRVLKDPKQRRFFKSNDLYELFTLTSPDASQSTETSAIFAGTGSDVQTPKCHLKRRIQPAFGADHDVPKRKKFPASNISVNDATSSEEKSEAKGAEVNAVTSNRSDPLKDDPHMSSNVTSNDRLGEETNAVSGPEELSVISGNGECSNSSGTGKTSMPSGDESIDEKLGLSYKRERPSQAQTEAFWENKQMENNFYKHKSKTKHHSVAEEETLEKHLRPKQKPKNSKHCRDAKFEGTRIPHLVKKRRYQKQDSENKSEAKEQSNDDYVLEKLFKKSVGVHSVMKHDAIMDGASPDYVLVEAEANRVAQDALKALRLSRQRCLGAVSGVPTWTGHRGISGAPAGKKSRFGKKRNSNFSVQHPSSTSPTEKCQDGIMKKEGKDNVPEHFSGRAEDADSSSGPLASSSLLAKMRARNHLILPERLESESGHLQEASALLPTTEHDDLLVEMRNFIAFQAHTDGQASTREILQEFESKLSASQSCVFRELLRNLCTFHRTSGGEGIWKLKPEYC

SEQ ID NO: 899 - protein, 598 aa, Homo sapiens
MSASAQQLAEELQIFGLDCEEALIEKLVELCVQYGQNEEGMVGELIAFCTSTHKVGLTSEILNSFEHEFLSKRLSKARHSTCKDSGHAGARDIVSIQELIEVEEEEEILLNSYTTPSKGSQKRAISTPETPLTKRSVSTRSPHQLLSPSSFSPSATPSQKYNSRSNRGEVVTSFGLAQGVSWSGRGGAGNISLKVLGCPEALTGSYKSMFQKLPDIREVLTCKIEELGSELKEHYKIEAFTPLLAPAQEPVTLLGQIGCDSNGKLNNKSVILEGDREHSSGAQIPVDLSELKEYSLFPGQVVIMEGINTTGRKLVATKLYEGVPLPFYQPTEEDADFEQSMVLVACGPYTTSDSITYDPLLDLIAVINHDRPDVCILFGPFLDAKHEQVENCLLTSPFEDIFKQCLRTIIEGTRSSGSHLVFVPSLRDVHHEPVYPQPPFSYSDLSREDKKQVQFVSEPCSLSINGVIFGLTSTDLLFHLGAEEISSSSGTSDRFSRILKHILTQRSYYPLYPPQEDMAIDYESFYVYAQLPVTPDVLIIPSELRYFVKDVLGCVCVNPGRLTKGQVGGTFARLYLRRPAADGAERQSPCIAVQVVRI

SEQ ID NO: 900 - protein, 904 aa, Homo sapiens
MAESSESFTMASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAAERAMRQRDREAGRGLGRMRRGLLYDSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMRSMRKTFARYLSFRRDNNELLLFILKQLVAEQVTYQRNRFGAQQDTIEVPEKDLVDKARQINIHNLSAFYDSELFRMNKFSHDLKRKMILQQF

SEQ ID NO: 901 - protein, 1077 aa, Homo sapiens
PRFRCLFCLQFAIPASRMEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQHLKQTHLEYFSLWCLMLTLESQSKDNKKNHQNIWLMPASEMEKSGSCIGNLIRMEHVKIVCDGQYLHNFQCKHGAIPVTNLMAGDRVIVSGEERSLFALSRGYVKEINMTTVTCLLDRNLSVLPESTLFRLDQEEKNCDIDTPLGNLSKLMENTFVSKKLRDLIIDFREPQFISYLSSVLPHDAKDTVACILKGLNKPQRQAMKKVLLSKDYTLIVGMPGTGKTTTICTLVRILYACGFSVLLTSYTHSAVDNILLKLAKFKIGFLRLGQIQKVHPAIQQFTEQEICRSKSIKSLALLEELYNSQLIVATTCMGINHPIFSRKIFDFCIVDEASQISQPICLGPLFFSRRFVLVGDHQQLPPLVLNREARALGMSESLFKRLEQNKSAVVQLTVQYRMNSKIMSLSNKLTYEGKLECGSDKVANAVINLRHFKDVKLELEFYADYSDNPWLMGVFEPNNPVCFLNTDKVPAPEQVEKGGVSNVTEAKLIVFLTSIFVKAGCSPSDIGIIAPYRQQLKIINDLLARSIGMVEVNTVDKYQGRDKSIVLVSFVRSNKDGTVGELLKDWRRLNVAITRAKHKLILLGCVPSLNCYPPLEKLLNHLNSEKLIIDLPSREHESLCHILGDFQRE

SEQ ID NO: 902 - protein, 358 aa, Homo sapiens
MSEEQFGGDGAAAAATAAVGGSAGEQEGAMVAPAQGAAAAAGSGAGTGGGTASGGTEGGSAESEGAKIDASKNEEDEGHSNSSPRHTEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKGEEPVKKIMEKKYHNVGLSKCEIKVAMSKEQYQQQQQWGSRGGFAGRARGRGGDQQSGYGKVSRRGGHQNSYKPYLNYSICNLSPTGGEAVFSNLKIHLNGSCHLLIAVQTKFLYQVPEWKYDVGSL

SEQ ID NO: 903 - protein, 169 aa, Homo sapiens
MAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 904 - protein, 1717 aa, Homo sapiens
MLISKNMPWRRLQGISFGMYSAEELKKLSVKSITNPRYLDSLGNPSANGLYDLALGPADSKEVCSTCVQDFSNCSGHLGHIELPLTVYNPLLFDKLYLLLRGSCLNCHMLTCPRAVIHLLLCQLRVLEVGALQAVYELERILSRFLEENADPSASEIREELEQYTTEIVQNNLLGSQGAHVKNVCESKSKLIALFWKAHMNAKRCPHCKTGRSVVRKEHNSKLTITFPAMVHRTAGQKDSEPLGIEEAQIGKRGYLTPTSAREHLSALWKNEGFFLNYLFSGMDDDGMESRFNPSVFFLDFLVVPPSRSRPVSRLGDQMFTNGQTVNLQAVMKDVVLIRKLLALMAQEQKLPEEVATPTTDEEKDSLIAIDRSFLSTLPGQSLIDKLYNIWIRLQSHVNIVFDSEMDKLMRDKYPGIRQILEKKEGLFRKHMMGKRVDSTARSVICPDMYINTNEIGIPMVFATKLTYPQPVTPWNVQELRQAVINGPNVHPGASMVINEDGSRTALSAVDMTQREAVAKQLLTPATGAPKPQGTKIVCRHVKNGDILLLNRQPTLHRPSIQAHRARILPEEKVLRLHYANCKAYNADFDGDEMNAHFPQSELGRAEAYVLACTDQQYLVPKDGQPLAGLIQDHMVSGASMTTRGCFFTREHYMELVYRGLTDKVGRVKLLSPSILKPFPLWTGKQVVSTLLINIIPEDHIPLNLSGKAKITGKAWVKETPRSVPGFNPDSMCESQVIIREGELLCGVLDKAHYGSSAYGLVHCCYEIYGGETSGKVLTCLARLFTAYLQLYRGFTLGVEDILVKPKRDVKRQRIIEESTHCGPQAVRAALNLPEAASYDEVRGKWQDAHLGKDQRDFNMIDLKFKEEVNHYSNEINKACMPFGLHRQFPENTLQLMVQSGAKGSTVNTMQISCLLGQIELEGRSTPLMASGKSLPCFEPYEFTPRAGGFVTGRFLTGIKPPEFFFHCMAGREGLVDTAVKTSRSGYLQRCIIKHLEGLVVQYDLTVRDSDGSVVQFLYGEDGLDIPKTQFLQPKQFPFLASNYEVIMKSQHLHEVLSRADPKKALHHFRAIKKWQSKHPNTLLRRGAFLSYSQKIQEAVKALKLESENRNGRRPWDSGRMLRMWYELDEESRRKYQKKAAACPDPSLSVWRPDIYFASVSETFETKVDDYSQEWAAQTEKSYEKSELSLDRLRTLLQLKWQRSLCEPGEAVGLLAAQSIGEPSTQMTLNTFHFAGRGEMNVTLGIPRLREILMVASANIKTPMMSVPVLNTKKALKRVKSLKKQLTRVCLGEVLQKIDVQESFCMEEKQNKFQVYQLRFQFLPHAYYQQEKCLRPEDILRFMETRFFKLLMESIKKKNNKASAFRNVNTRRATQRDLDNAGELGRSRGEQEGDEEEEGHIVDAEAEEGDADASDAKRKEKQEEEVDYESEEEEEREGEENDDEDMQEERNPHREGARKTQEQDEEVGLGGPVPSHPPDAAPETHPQPGAPGAEAMERRVQAVREIHPFIDDYQYDTEESLWCQVTVKLPLMKINFDMSSLVVSLAHGAVIYATKGITRCLLNETTNNKNEKELVLNTEGINLPELFKYAEVLDLRRLYSNDIHAIANTYGIEALRVIEKEIKDVFAVYGIAVDPRHLSLVADYMCFEGVYKPLNRFGIRSNSSPLQQMTFETSFQFLKQATMLGSHDELRSPSACLVVGKVVRGGTGLFELKQPLR

SEQ ID NO: 905 - protein, 554 aa, Homo sapiens
MTAPCSQPAQLPGRRQLGLVPFPPPPPRTPLLWLLLLLLAAVAPARGWESGDLELFDLVEEVQLNFYQFLGVQQDASSADIRKAYRKLSLTLHPDKNKDENAETQFRQLVAIYEVLKDDERRQRYDDILINGLPDWRQPVFYYRRVRKMSNAELALLLFIILTVGHYAVVWSIYLEKQLDELLSRKKREKKKKTGSKSVDVSKLGASEKNERLLMKPQWHDLLPCKLGIWFCLTLKALPHLIQDAGQFYAKYKETRLKEKEDALTRTELETLQKQKKVKKPKPEFPVYTPLETTYIQSYDHGTSIEEIEEQMDDWLENRNRTQKKQAPEWTEEDLSQLTRSMVKFPGGTPGRWEKIAHELGRSVTDVTTKAKQLKDSVTCSPGMVRLSELKSTVQNSRPIKTATTLPDDMITQREDAEGVAAEEEQEGDSGEQETGATDARPRRRKPARLLEATAKPEPEEKSRAKRQKDFDIAEQNESSDEESLRKERARSAEEPWTQNQQKLLELALQQYPRGSSDRWDKIARCVPSKSKEDCIARYKLLVELVQKKKQAKS

SEQ ID NO: 906 - protein, 342 aa, Homo sapiens
MASLSQLSSHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLSATSGEEGNPNGGHCAWGLHCLLAALLLDPCSQYPLPDMPRVPRALQCHDMAGLRE

SEQ ID NO: 907 - protein, 462 aa, Homo sapiens
ATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGELQKRKEVVHTVSLHEIDVINSRTQGFLALFSGDTGEIKSEVREQINAKVAEWREEGKAEIIPGVLFIDEVHMLDIESFSFLNRALESDMAPVLIMATNRGITRIRGTSYQSPHGIPIDLLDRLLIVSTTPYSEKDTKQILRIRCEEEDVEMSEDAYTVLTRIGLETSLRYAIQLITAASLVCRKRKGTEVQVDDIKRVYSLFLDESRSTQYMKEYQDAFLFNELKGETMDTS

SEQ ID NO: 908 - protein, 600 aa, Homo sapiens
MVLILGRRLNREDLGVRDSPATKRKVFEMDPKSLTGHEFFDFSSGSSHAENILQIFNEFRDSRLFTDVIICVEGKEFPCHRAVLSACSSYFRAMFCNDHRESREMLVEINGILAEAMECFLQYVYTGKVKITTENVQYLFETSSLFQISVLRDACAKFLEEQLDPCNCLGIQRFADTHSLKTLFTKCKNFALQTFEDVSQHEEFLELDKDELIDYICSDELVIGKEEMVFEAVMRWVYRAVDLRRPLLHELLTHVRLPLLHPNYFVQTVEVDQLIQNSPECYQLLHEARRYHILGNEMMSPRTRPRRSTGYSEVIVVVGGCERVGGFNLPYTECYDPVTGEWKSLAKLPEFTKSEYAVCALRNDILVSGGRINSRDVWIYNSQLNIWIRVASLNKGRWRHKMAVLLGKVYVVGGYDGQNRLSSVECYDSFSNRWTEVAPLKEAVSSPAVTSCVGKLFVIGGGPDDNTCSDKVQSYDPETNSWLLRAAIPIAKRCITAVSLNNLIYVAGGLTKAIYCYDPVEDYWMHVQNTFSRQENCGMSVCNGKIYILGGRRENGEATDTILCYDPATSIITGVAAMPRPVSYHGCVTIHRYNEKCFKL

SEQ ID NO: 909 - protein, 1278 aa, Homo sapiens
MAQSKRHVYSRTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLRGLKPKKAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGEEQQRGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 910 - protein, 4646 aa, Homo sapiens [sequence omitted]

SEQ ID NO: 911 - protein, 558 aa, Homo sapiens
CVSGLEVNGIWPKYSDINDINSVDGNYIGQVLVTADDYGIIKLFRYPCLRKGAKFRKYIGHSAHVTNVRWSHDYQWVISIGGADHSVFQWKFIPERKLKDAVHIAPQESLADSHSDESDSDLSDVPELDSEIEQETQLTYRRQVYKEDLPQLKEQCKEKQKSATSKRRERAPGNSIRLHFVHGYRGYDCRSNLFYTQIGEIVYHVAAVGVIYNRQQNTQRFYLGHDDDILCLTIHPLKDYVATGQVGRDPSIHIWDTETIKPLSILKGHHQYGVSAVDFSADGKRLASVGIDDSHTVVLWDWKKGEKLSIARGSKDKIFVVKMNPYVPDKLITAGIKHMKFWRKAGGGLIGRKGYIGTLGKNDTMMCAVYGWTEEMAFSGTSTGDVCIWRDIFLVKTVKAHDGPVFSMHALEKGFVTGGKDGIVALWDDSFERCLKTYAIKRAALAPGSKGLLLEDNPSIRAISLGHGHILVGTKNGEILEVDKSGPITLLVQGHMEGEVWGLATHPYLPICATVSDDKTLRIWDLSPSHCMLAVRKLKKGGRCCCFSPDGKALAVGL

SEQ ID NO: 912 - protein, 883 aa, Homo sapiens
MAENSVLTSTTGRTSLADSSIFDSKVTEISKENLLIGSTSYVEEEMPQIETRVILVQEAGKQEELTKALKDIKVGFVKMESVEEFEGLDSPEFENVFVVTDFQDSVFNDLYKADCRVIGPPVVLNCSQKGEPLPFSCRPLYCTSMMNLVLCFTGFRKKEELVRLVTLVHHMGGVIRKDFNSKVTHLVANCTQGEKFRVAVSLGTPIMKPEWIYKAWERRNEQDFYAAVDDFRNEFKVPPFQDCIFSFLGFSDEEKTNMEEMTEMQGGKYLPLGDERCTHLVVEENIVKDLPFEPSKKLYVVKQEWFWGSIQMDARAGETMYLYEKANTPELKKSVSMLSLNTPNSNRKRRRLKETLAQLSRDTDVSPFPPRKRPSAEHSLSIGSLLDISNTPESSINYGDTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEKQKPRFHAFLKINQAKPECGRQSLVELLIRPVQRLPSVALLLNDLKKHTADENPDKSTLEKAIGSLKEVMTHINEDKRKTEAQKQIFDVVYEVDGCPANLLSSHRSLVQRVETISLGEHPCDRGEQVTLFLFNDCLEIARKRHKVIGTFRSPHGQTRPPASLKHIHLMPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAGIPSPSLVSLPSFFERRSHTLSRSTTHLI

SEQ ID NO: 913 - protein, 148 aa, Homo sapiens
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGLKLRGKDIGKPIEKGPRAK

SEQ ID NO: 914 - protein, 480 aa, Homo sapiens
MKRSVAVWLLVGLSLGVPQFGKGDICDPNPCENGGICLPGLADGSFSCECPDGFTDPNCSSVVEVASDEEEPTSAGPCTPNPCHNGGTCEISEAYRGDTFIGYVCKCPRGFNGIHCQHNINECEVEPCKNGGICTDLVANYSCECPGEFMGRNCQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGMKSGHIQDYQITASSIFRTLNMDMFTWEPRKARLDKQGKVNAWTSGHNDQSQWLQVDLLVPTKVTGIITQGAKDFGHVQFVGSYKLAYSNDGEHWTVYQDEKQRKDKVFQGNFDNDTHRKNVIDPPIYARHIRILPWSWYGRITLRSELLGCTEEE

SEQ ID NO: 915 - protein, 857 aa, Homo sapiens
VNFTVDQIRAIMDKKANIRNMSVIAHVDHGKSTLTDSLVCKAGIIASARAGETRFTDTRKDEQERCITIKSTAISLFYELSENDLNFIKQSKDGAGFLINLIDSPGHVDFSSEVTAALRVTDGALVVVDCVSGVCVQTETVLRQAIAERIKPVLMMNKMDRALLELQLEPEELYQTFQRIVENVNVIISTYGEGESGPMGNIMIDPVLGTVGFGSGLHGWAFTLKQFAEMYVAKFAAKGEGQLGPAERAKKVEDMMKKLWGDRYFDPANGKFSKSATSPEGKKLPRTFCQLILDPIFKVFDAIMNFKKEETAKLIEKLDIKLDSEDKDKEGKPLLKAVMRRWLPAGDALLQMITIHLPSPVTAQKYRCELLYEGPPDDEAAMGIKSCDPKGPLMMYISKMVPTSDKGRFYAFGRVFSGLVSTGLKVRIMGPNYTPGKKEDLYLKPIQRTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKAYLPVNESFGFTADLRSNTGGQAFPQCVFDHWQILPGDPFDNSSRPSQVVAETRKRKGLKEGIPALDNFLDKL

SEQ ID NO: 916 - protein, 388 aa, Homo sapiens
MNTMYVMMAQILRSHLIKATVIPNRVKMLPYFGIIRNRMMSTHKSKKKIREYYRLLNVEEGCSADEVRESFHKLAKQYHPDSGSNTADSATFIRIEKAYRKVLSHVIEQTNASQSKGEEEEDVEKFKYKTPQHRHYLSFEGIGFGTPTQREKHYRQFRADRAAEQVMEYQKQKLQSQYFPDSVIVKNIRQSKQQKITQAIERLVEDLIQESMAKGDFDNLSGKGKPLKKFSDCSYIDPMTHNLNRILIDNGYQPEWILKQKEISDTIEQLREAILVSRKKLGNPMTPTEKKQWNHVCEQFQENIRKLNKRINDFNLIVPILTRQKVHFDAQKEIVRAQKIYETLIKTKEVTDRNPNNLDQGEGEKTPEIKKGFLNWMNLWKFIKIRSF

SEQ ID NO: 917 - protein, 766 aa, Homo sapiens
MGRRRLLVWLCAVAALLSGAQARGTPLLARPAPPGASRYSLYTTGWRPRLRPGPHKALCAYVVHRNVTCILQEGAESYVKAEYRQCRWGPKCPGTVTYRTVLRPKYKVGYKTVTDLAWRCCPGFTGKRCPEHLTDHGAASPQLEPEPQIPSGQLDPGPRPPSYSRAAPSPHGRKGPGLFGERLERLEGDVQRLAQTYGTLSGLVASHEDPNRMTGGPRAPAVPVGFGVIPEGLVGPGDRARGPLTPPLDEILSKVTEVSNTLQTKVQLLDKVHGLALGHEAHLQRLREAPPSPLTSLALLEEYVDRRLHRLWGSLLDGFEQKLQGVQSECDLRVQEVRRQCEEGQAASRRLHQSLDGRELALRQELSQLGSQLQGLSVSGRGSCCGQLALINARMDGLERALQAVTETQRGPGAPAGDELTRLSAAMLEGGVDGLLEGLETLNGTEGGARGCCLRLDMGGWGVGGFGTMLEERVQSLEERLATLAGELSHDSASPGRSARPLVQTELAVLEQRLVSLETSCTPSTTSAILDSLVAEVKAWQSRSEALLRQVASHAALLQQLNGTVAEVQGQLAEGTGSSLQGEITLLKVNLNSVSKSLTGLSDSVSQYSDAFLAANTSLDERERKVEAEVQAIQEQVSSQGSRLQAGHRQVLNLRGELEQLKAGVAKVASGLSRCQDTAQKLQHTVGHFDQRVAQVEGACRRLGLLAAGLDSLPTEPLRPREGLWSHVDQLNRTLAQHTQDIARLRDDLLDCQAQLAEQVRPGQAN

SEQ ID NO: 918 - protein, 671 aa, Homo sapiens
MSELLDLSFLSEEEKDLILSVLQRDEEVRKADEKRIRRLKNELLEIKRKGAKRGSQHYSDRTCARCQESLGRLSPKTNTCRGCNHLVCRDCRIQESNGTWRCKVCAKEIELKKATGDWFYDQKVNRFAYRTGSEIIRMSLRHKPAVSKRETVGQSLLHQTQMGDIWPGRKIIQERQKEPSVLFEVPKLKSGKSALEAESESLDSFTADSDSTSRRDSLDKSGLFPEWKKMSAPKSQVEKETQPGGQNVVFVDEGEMIFKKNTRKILRPSEYTKSVIDLRPEDVVHESGSLGDRSKSVPGLNVDMEEEEEEEDIDHLVKLHRQKLARSSMQSGSSMSTIGSMMSIYSEAGDFGNIFVTGRIAFSLKYEQQTQSLVVHVKECHQLAYADEAKKRSNPYVKTYLLPDKSRQGKRKTSIKRDTVNPLYDETLRYEIPESLLAQRTLQFSVWHHGRFGRNTFLGEAEIQMDSWKLDKKLDHCLPLHGKISAESPTGLPSHKGELVVSLKYIPASKTPVGGDRKKSKGGEGGELQVWIKEAKNLTAAKAGGTSDSFVKGYLLPMRNKASKRKTPVMKKTLNPHYNHTFVYNGVRLEDLQHMCLELTVWDREPLASNDFLGGVRLGVGTGISNGEVVDWMDSTGEEVSLWQKMRQYPGSWAEGTLQLRSSMAKQKLGL

SEQ ID NO: 919 - protein, 834 aa, Homo sapiens
MKYKNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKESSLSASPAQDKRLFLDPDTAIERLQRLQQALEMGVSSLMALVTTDWRCYGYMERHINEIRTAVDKVELFLKEYLHFVKGAVANAACLPELILHNKMKRELQRVEDSHQILSQTSHDLNECSWSLNILAINKPQNKCDDLDRFVMVAKTVPDDAKQLTTTINTNAEALFRPGPGSLHLKNGPESIMNSTEYPHGGSQGQLLHPGDHKAQAHNKALPPGLSKEQAPDCSSSDGSERSWMDDYDYVHLQGKEEFERQQKELLEKENIMKQNKMQLEHHQLSQFQLLEQEITKPVENDISKWKPSQSLPTTNSGVSAQDRQLLCFYYDQCETHFISLLNAIDALFSCVSSAQPPRIFVAHSKFVILSAHKLVFIGDTLTRQVTAQDIRNKVMNSSNQLCEQLKTIVMATKMAALHYPSTTALQEMVHQVTDLSRNAQLFKRSLLEMATF

SEQ ID NO: 920 - protein, 1087 aa, Homo sapiens
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGEVGTGQYATTKGISQTNLITTVTPEKKAEEERDEEEDKRRKGEEVTPISAIRHEGKSPGLGTDSCPLSPPSTHCAPTSPTELRRRCKENDCKLPGYEPSRAEHLPGEPALDSDGPGRPYLGDQDVAFSYRQQTGKGTTLFSFSLQLPESFPSLLDDDGYLSFPNLSETNLLPQSLQHYLPIRSPSLVPCFLFIFFFLLSASFSVPYALTLSFPLALCLCYLEPKAASLSASLDNDPSDSSEEETDSERTDTAADGETTATESDQEEDAELKAQELEKTQDDLMKHQTNISELKRTFLETSTDTAVTNEWEKRLSTSPVRLAARQEDAPMIEPLVPEETKQSSGEKLMDGSEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 921 - protein, 896 aa, Homo sapiens
MAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVAMFLVYCALEKEPVPMSLPPALVPPSKRKTWVVSPAEKAKYDEIFLKTDKDMDGFVSGLEVREIFLKTGLPSTLLAHIWSLCDTKDCGKLSKDQFALAFHLISQKLIKGIDPPHVLTPEMIPPSDRASLQKNIIGSSPVADFSAIKELDTLNNEIVDLQREKNNVEQDLKEKEDTIKQRTSEVQDLQDEVQRENTNLQKLQAQKQQVQELLDELDEQKAQLEEQLKEVRKKCAEEAQLISSLKAELTSQESQISTYEEELAKAREELSRLQQETAELEESVESGKAQLEPLQQHLQDSQQEISSMQMKLMEMKDLENHNSQLNWCSSPHSILVNGATDYCSLSTSSSETANLNEHVEGQSNLESEPIHQESPARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 922 - protein, 163 aa, Homo sapiens
MSLLLLVVSALHILILILLFVATLDKSWWTLPGKESLNLWYDCTWNNDTKTWACSNVSENGWLKAVQVLMVLSLILCCLSFILFMFQLYTMRRGGLFYATGLCQLCTSVAVFTGALIYAIHAEEILEKHPRGGSFGYCFALAWVAFPLALVSGIIYIHLRKRE

SEQ ID NO: 923 - protein, 572 aa, Homo sapiens
MAAPRPSPAISVSVSAPAFYAPQKKFGPVVAPKPKVNPFRPGDSEPPPAPGAQRAQMGRVGEIPPPPPEDFPLPPPPLAGDGDDAEGALGGAFPPPPPPIEESFPPAPLEEEIFPSPPPPPEEEGGPEAPIPPPPQPREKVSSIDLEIDSLSSLLDDMTKNDPFKARVSSGYVPPPVATPFSSKSSTKPAAGGTAPLPPWKSPSSSQPLPQVPAPAQSQTQFHVQPQPQPKPQVQLHVQSQTQPVSLANTQPRGPPASSPAPAPKFSPVTPKFTPVASKFSPGAPGGSGSQPNQKLGHPEALSAGTGSPQPPSFTYAQQREKPRVQEKQHPVPPPAQNQNQVRSPGAPGPLTLKEVEELEQLTQQLMQDMEHPQRQNVAVNELCGRCHQPLARAQPAVRALGQLFHIACFTCHQCAQQLQGQQFYSLEGAPYCEGCYTDTLEKCNTCGEPITDRMLRATGKAYHPHCFTCVVCARPLEGTSFIVDQANRPHCVPDYHKQYAPRCSVCSEPIMPEPGRDETVRVVALDKNFHMKCYKCEDCGKPLSIEADDNGCFPLDGHVLCRKCHTARAQT

SEQ ID NO: 924 - protein, 1600 aa, Homo sapiens
MNKAPQSTGPPPAPSPGLPQPAFPPGQTAPVVFSTPQATQMNTPSQPRQHFYPSRAQPPSSAASRVQSAAPARPGPAAHVYPAGSQVMMIPSQISYPASQGAYYIPGQGRSTYVVPTQQYPVQPGAPGFYPGASPTELGTYAGAYYPARGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASVAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPPNLEEKKRYDREFLLGFQFIFASMQKPEGLPHISDVVLDKANKTPLRPLDPTRLQGINCGPDFTPSFANLGRTTLSTRGPPRGGPGGELPRGPQAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 925 - protein, 276 aa, Homo sapiens
SDQQLDCALDLMRRLPPQQIEKNLSDLIDLVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAGVILIKKAGDGSKKIKGCWDSIHVVEVQEKSSGRTAHYKLTSTVMLWLQTNKSGSGTMNLGGSLTRQMEKDETVSDCSPHIANIGRLVEDMENKIRSTLNEIYFGKTKDIVNGLRSIDAIPDNQKFKQLQRELSQVLTQRQIYIQPDN

SEQ ID NO: 926 - protein, 4349 aa, Homo sapiens [sequence omitted]

SEQ ID NO: 927 - protein, 507 aa, Homo sapiens
GSMKRTPTAEEREREAKKLRLLEELEDTWLPYLTPKDDEFYQQWQLKYPKLILREASSVSEELHKEVQEAFLTLHKHGCLFRDLVRIQGKDLLTPVSRILIGNPGCTYKYLNTRLFTVPWPVKGSNIKHTEAEIAAACETFLKLNDYLQIETIQALEELAAKEKANEDAVPLCMSADFPRVGMGSSYNGQDEVDIKSRAAYNVTLLNFMDPQKMPYLKEEPYFGMGKMAVSWHHDENLVDRSAVAVYSYSCEGPEEESEDDSHLEGRDPDIWHVGFKISWDIETPGLAIPLHQGDCYFMLDDLNATHQHCVLAGSQPWFSSTHRVAECSTGTLDYILQRCQLALQNVCDDVDNDDVSLKSFEPAVLKQGEEIHNEVEFEWLRQFWFQGNRYRKCTDWWCQPMAQLEALWKKMEGVTNAVLHEVKREGLPVEQRNEILTAILASLTARQNLRREWHARCQSRIARTLPADQKPECRPYWEKDDASMPLPFDLTDIVSELRGQLLEAKP

SEQ ID NO: 928 - protein, 532 aa, Homo sapiens
MPLFLILCLLQGSSFALPQKRPHPRWLWEGSLPSRTHLRAMGTLRPSSPLCWREESSFAAPNSLKGSRLVSGEPGGAVTIQCHYAPSSVNRHQRKYWCRLGPPRWICQTIVSTNQYTHHRYRDRVALTDFPQRGLFVVRLSQLSPDDIGCYLCGIGSENNMLFLSMNLTISAGPASTLPTATPAAGELTMRSYGTASPVANRWTPGTTQTLGQGTAWDTVASTPGTSKTTASAEGRRTPGATRPAAPGTGSWAEGSVKAPAPIPESPPSKSRSMSNTTEGVWEGTRSSVTNRARASKDRREMTTTKADRPREDIEGVRIALDAAKKVLGTIGPPALVSETLAWEILPQATPVSKQQSQGSIGETTPAAGMWTLGTPAADVWILGTPAADVWTSMEAASGEGSAAGDLDAATGDRGPQATLSQTPAVGPWGPPGKESSVKRTFPEDESSSRTLAPVSTMLALFMLMALVLLQRKLWRRRTSQEAERVTLIQMTHFLEVNPQADQLPHVERKMLQDDSLPAGASLTAPERNPGP

SEQ ID NO: 929 - protein, 254 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 930 - protein, 655 aa, Homo sapiens
MKGASEEKLASVSNLVTVFENSRTPEAAPRGQRLEDVHHRPECRPPESPGPREKTNVGEAVGSEPRTVSRRYLNSLKNKLSSEAWRKSCQPVTLSGSGTQEPEKKIVQELLETEQAYVARLHLLDQVFFQELLKTARSSKAFPEDVVRVIFSNISSIYQFHSQFFLPELQRRLDDWTANPRIGDVIQKLAPFLKMYSEYVKNFERAAELLATWTDKSPLFQEVLTRIQSSEASGSLTLQHHMLEPVQRIPRYELLLKEYIQKLPAQAPDQADAQKALDMIFSAAQHSNAAITEMERLQDLWEVYQRLGLEDDIVDPSNTLLREGPVLKISFRRNDPMERYLFLFNNMLLYCVPRVIQVGAQFQVRTRIDVAGMKVRELMDAEFPHSFLVSGKQRTLELQARSQEEMISWMQAFQAAIDQIEKRNETFKAAAQGPEGDIQEQELQSEELGLRAPQWVRDKMVTMCMRCQEPFNALTRRRHHCRACGYVVCARCSDYRAELKYDDNRPNRVCLHCYAFLTGNVLPEAKEDKRRGILEKGSSATPDQSLMCSFLQLIGDKWGKSGPRGWCVIPRDDPLVLYVYAAPQDMRAHTSIPLLGYQVTVGPQGDPRVFQLQQSGQLYTFKAETEELKGRWVKAMERAASGWSPSWPNDGDLSD

SEQ ID NO: 931 - protein, 504 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 932 - protein, 802 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 933 - protein, 821 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 934 - protein, 259 aa, Homo sapiens
MPKTMHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYGSLEEVFLLQNILVSCHRTTLHVLKCMYLLVLNNNTCAEGKIPPDATLIFEIELYAVTKGPRSIETFKQIDMDNDRQLSKAEINLYLQREFEKDEKPRDKSYQDAVLEDIFKKNDHDGDGFISPKEYNVYQHDEL

SEQ ID NO: 935 - protein, 594 aa, Homo sapiens
MAVEELQSIIKRCQILEEQDFKEEDFGLFQLAGQRCIEEGHTDQLLEIIQNEKNKVIIKNMGWNLVGPVVRCLLCKDKEDSKRKVYFLIFDLLVKLCNPKELLLGLLELIEEPSGKQISQSILLLLQPLQTVIQKLHNKAYSIGLALSTLWNQLSLLPVPYSKEQIQMDDYGLCQCCKALIEFTKPFVEEVIDNKENSLENEKLKDELLKFCFKSLKCPLLTAQFFEQSEEGGNDPFRYFASEIIGFLSAIGHPFPKMIFNHGRKKRTWNYLEFEEEENKQLADSMASLAYLVFVQGIHIDQLPMVLSPLYLLQFNMGHIEVFLQRTEESVISKGLELLENSLLRIEDNSLLYQYLEIKSFLTVPQGLVKVMTLCPIETLRKKSLAMLQLYINKLDSQGKYTLFRCLLNTSNHSGVEAFIIQNIKNQIDMSLKRTRNNKWFTGPQLISLLDLVLFLPEGAETDLLQNSDRIMASLNLLRYLVIKDNENDNQTGLWTELGNIENNFLKPLHIGLNMSKAHYEAEIKNSQEAQKSKDLCSITVSGEEIPNMPPEMQLKVLHSALFTFDLIESVLARVEELIEIKTKSTSEENIGIK

SEQ ID NO: 936 - protein, 193 aa, Homo sapiens
MFELFNVPGFYIAVQEVLALEVSWTSQQVGEYMLMSIVIDKGDGVTLVLPVVEGYVIGSCINHILIVGDTVYFIQQLLREREVGIPLEQSLETTKVIKEKYCYICPDIVKEFAKYDVDPWKWMKQYTGINVINQEKFIINVGYKRFLQPEIFFYPEFANPDFMESILNVVDEYKTVPLMCIVHCIRMLFFQGV

SEQ ID NO: 937 - protein, 532 aa, Homo sapiens
MGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPKKSFPGLNHFKGKCFHSSDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTGTSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPYSPYQFRLVGPGQWPGARNAILTQWDRSLKPMQTRVVGRLQKPCFFFHWLKLFAIPILLIAVFLVLT

SEQ ID NO: 938 - protein, 1269 aa, Homo sapiens
MEATGVLPFVRGVDLSGNDFKGGYFPENVKAMTSLRWLKLNRTGLCYLPEELAALQKLEHLSVSHNNLTTLHGELSSLPSLRAIVARANSLKNSGVPDDIFKLDDLSVLDLSHNQLTECPRELENAKNMLVLNLSHNSIDTIPNQLFINLTDLLYLDLSENRLESLPPQMRRLVHLQTLVLNGNPLLHAQLRQLPAMTALQTLHLRSTQRTQSNLPTSLEGLSNLADVDLSCNDLTRVPECLYTLPSLRRLNLSSNQITELSLCIDQWVHVETLNLSRNQLTSLPSAICKLSKLKKLYLNSNKLDFDGLPSGIGKLTNLEEFMAANNNLELVPESLCRCPKLRKLVLNKNHLVTLPEAIHFLTEIEVLDVRENPNLVMPPKPADRAAEWYNIDFSLQNQLRLAGASPATVAAAAAAGSGPKDPMARKMRLRRRKDSAQDDQAKQVLKGMSDVAQEKNKKQEESADARAPSGKVRRWDQGLEKPRLDYSEFFTEDVGQLPGLTIWQIENFVPVLVEEAFHGKFYEADCYIVLKTFLDDSGSLNWEIYYWIGGEATLDKKACSAIHAVNLRNYLGAECRTVREEMGDESEEFLQVFDNDISYIEGGTASGFYTVEDTHYVTRMYRVYGKKNIKLEPVPLKGTSLDPRFVFLLDRGLDIYVWRGAQATLSSTTKARLFAEKINKNERKGKAEITLLVQGQELPEFWEALGGEPSEIKKHVPEDFWPPQPKLYKVGLGLGYLELPQINYKLSVEHKQRPKVELMPRMRLLQSLLDTRCVYILDCWSDVFIWLGRKSPRLVRAAALKLGQELCGMLHRPRHATVSRSLEGTEAQVFKAKFKNWDDVLTVDYTRNAEAVLQSPGLSGKVKRDAEKKDQMKADLTALFLPRQPPMSLAEAEQLMEEWNEDLDGMEGFVLEGKKFARLPEEEFGHFYTQDCYVFLCRYWVPVEYEEEEKKEDKEEKAEGKEGEEATAEAEEKQPEEDFQCIVYFWQGREASNMGWLTFTFSLQKKFESLFPGKLEVVRMTQQQENPKFLSHFKRKFIIHRGKRKAVQGAQQPSLYQIRTNGSALCTRCIQINTDSSLLNSEFCFILKVPFESEDNQGIVYAWVGRASDPDEAKLAEDILNTMFDTSYSKQVINEGEEPENFFWVGIGAQKPYDDDAEYMKHTRLFRCSNEKGYFAVTEKCSDFCQDDLADDDIMLLDNGQEVYMWVGTQTSQVEIKLSLKACQVYIQHMRSKEHERPRRLRLVRKGNEQHAFTRCFHAWSAFCKALA

SEQ ID NO: 939 - protein, 640 aa, Homo sapiens
MGERTLHAAVPTPGYPESESIMMAPICLVENQEEQLTVNSKALEILDKISQPVVVVAIVGLYRTGKSYLMNRLAGKRNGFPLGSTVQSETKGIWMWCVPHLSKPNHTLVLLDTEGLGDVEKSNPKNDSWIFALAVLLSSSFVYNSVSTINHQALEQLHYVTELAELIRAKSCPRPDEAEDSSEFASFFPDFIWTVRDFTLELKLDGNPITEDEYLENALKLIPGKNPKIQNSNMPRECIRHFFRKRKCFVFDRPTNDKQYLNHMDEVPEENLERHFLMQSDNFCSYIFTHAKTKTLREGIIVTGKRLGTLVVTYVDAINSGAVPCLENAVTALAQLENPAAVQRAADHYSQQMAQQLRLPTDTLQELLDVHAACEREAIAVFMEHSFKDENHEFQKKLVDTIEKKKGDFVLQNEEASAKYCQAELKRLSEHLTESILRGIFSVPGGHNLYLEEKKQVEWDYKLVPRKGVKANEVLQNFLQSQVVVEESILQSDKALTAGEKAIAAERAMKEAAEKEQELLREKQKEQQQMMEAQERSFQENIAQLKKKMERERENLLREHERLLKHKLKVQEEMLKEEFQKKSEQLNKEINQLKEKIESTKNEQLRLLKILDMASNIMIVTLPGASKLLGVGTKYLGSRI

SEQ ID NO: 940 - protein, 2646 aa, Homo sapiens
SSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGHEHIPGSPYRVVVP

SEQ ID NO: 941 - protein, 686 aa, Homo sapiens
MKIVIRGDRNTGKTALWHRLQGRPFVEEYIPTQEIQVTSIHWSYKTTDDIVKVEVWDVVDKGKCKKRGDGLKMENDPQEAESEMALDAEFLDVYKNCNGVVMMFDITKQWTFNYILRELPKVPTHVPVCVLGNYRDMGEHRVILPDDVRDFIDNLDRPPGSSYFRYAESSMKNSFGLKYLHKFFNIPFLQLQRETLLRQLETNQLDMDATLEELSVQQETEDQNYGIFLEMMEARSRGHASPLAANGQSPSPGSQSPVVPAGAVSTGSSSPGTPQPAPQLPLNAAPPSSVPPVPPSEALPPPACPSAPAPRRSIISRLFGTSPATEAAPPPPEPVPAAEGPATVQSVEDFVPDDRLDRSFLEDTTPARDEKKVGAKAAQQDSDSDGEALGGNPMVAGFQDDVDLEDQPRGSPPLPAGPVPSQDITLSSEEEAEVAAPTKGPAPAPQQCSEPETKWSSIPASKPRRGTAPTRTAAPPWPGGVSVRTGPEKRSSTRPPAEMEPGKGEQASSSESDPEGPIAAQMLSFVMDDPDFESEGSDTQRRADDFPVRDDPSDVTDEDEGPAEPPPPPKLPLPAFRLKNDSDLFGLGLEEAGPKESSEEGKEGKTPSKEKKKKKKKGKEEEEKAAKKKSKHKKSKDKEEGKEERRRRQQRPPRSRERTAADELEAFLGGGAPGGRHPGGGDYEEL

SEQ ID NO: 942 - protein, 732 aa, Homo sapiens
MERGGGGSGTGSRPEGTARGTSLPGKIAEPGAVRTSQPNYRPQGMEGFLKSDERQRLAKERREEREKCLAAREQQILEKQKRARLQYEKQMEERWRKLEEQRQREDQKRAAVEEKRKQKLREEEERLEAMMRRSLERTQQLELKKKYSWGAPLAIGPGGHDACDKLSTSTMSLPKPTEPPMNKRLSSSTVAISYSPDRVFHVCPRLAPLGPLNPSYKSSPTRNIEKKKATSTSTSGAGDVGKEALSGGEASLVEKVKRGQRTATSLPVVNFGSPLRRCEFSGGIPKRPSSPVISKTATKAYPQSPKTTKPPYPGSPVKYRLPALSGQDMPKRKAEKEKSNKEREGTLAQQAAGPQGEEALEKHVVDKHASEKHAAAAGGKAENSAALGKPTAGTTDAGEAAKILAEKRRQARLQKEQEEQERVEKEEQDRLEREELKRKAEEERLRLEEEARKQEEERKRQEEEKKKQEGEEKRKAGEEAKRKAEEELLLKEKQEQEKQEKAMIEKQKEAAETKAREVAEQMRLEREQIMLQIEQERLERKKRIDEIMKRTRKSDVPPQVKKEDPKVGVQPAVCVEKKTKLVVPNKMEINGLNTCQEVNGVDHAAPETYPQDIFSNGLKPAGGLIHLDALDGKSNSLDDSTEEVQSMDVSPVSKEELISIPEFSPVSEMIPGVSLDQNGTGNARALQDLLDFTGPPTFPKRSSENLSLDDCNKNLIEGFNSPGQETPLNTFC

SEQ ID NO: 943 - protein, 575 aa, Homo sapiens
ILIGEDHVEDLDKSKFKTKIRRLYDIANVLSSLDLIKKVHVTEERGRKPAFKWTGPEISPNTSGSSPVIHFTPSDLEVRRSSKENCAKNLFSTRGKPNFTRHPSLIKLVKSIESDRRKINSAPSSPIKTNKAESSQNSAPFPSKMAQLAAICKMQLEEQSSESRQKVKVQLARSGPCKPVAPLDPPVNAEMELTAPSLIQPLGMVPLIPSPLSSAVPLILPQAPSGPSYAIYLQPTQAHQSVTPPQGLSPTVCTTHSSKATGSKDSTDATTEKAANDTSKASASTRPGSLLPAPERQGAKSRTREPAGERGSKRASMLEDSGSKKKFKEDLKGLENVSATLFPSGYLIPLTQCSSLGAESILSGKENSSALSPNHRIYSSPIAGVIPVTSSELTAVNFPSFHVTPLKLMVSPTSVAAVPVGNSPALASSHPVPIQNPSSAIVNFTLQHLGLISPNVQLSASPGSGIVPVSPRIESVNVAPENAGTQQGRATNYDSPVPGQSQPNGQSVAVTGAQQPVPVTPKGSQLVAESFFRTPGGPTKPTSSSCMDFEGANKTSLGTLFVPQRKLEVSTEDVH

SEQ ID NO: 944 - protein, 214 aa, Homo sapiens
MENEKENLFCEPHKRGLMKTPLKESTTANIVLAEIQPDFGPLTTPTKPKEGSQGEPWTPTANLKMLISAVSPEIRNRDQKRGLFDNRSGLPEAKDCIHEHLSGDEFEKSQPSRKEKSLGLLCHKFLARYPNYPNPAVNNDICLDEVAEELNVERRRIYDIVNVLESLHMVSRLAKNRYTWHGRHNLNKTLGTLKSIGEENKYAEQIMMIKKKKK

SEQ ID NO: 945 - protein, 655 aa, Homo sapiens
MCIHQLNLLATNPNLPITSVLGKQHPIEAHHLSSICDIMEKAMVNGDTCIIRCILVVFQVVFKFFFSPQTERNRDIIRRSGLLLWQLLMAPKDQICPEIQKEVCLAISSGLNILYPGETEINNLLKLVLTEGERNSGLSQLRDVILTNLAEQLQNNRFGSDEDDHYRLNDELLHYILKIVVRESCILITKCQTVSKDDFQKLLSTVPAASSCLRYLMAVQNHLLSNTILIKPDENDDSDSSLQGETLKVQELKVSILALATQILTGCDEVLEMLQQVTTALINSDIADREQRLKGLEQVTKATMLGHLLPVLLTSLMHPNLQTLIMADALMPQLVQLVLYTSQTALLLKTQCPVFAEVGCSPCGAPDQKCRLFPDERMLEEKEEPGFLTGLKIPAPWAAGKTVETVHPVRDNYKFKETVHIPGARCLYLRFDSRCSSQYDYDKLVICAGPNTNSRKVAEYGGNTLGYGSRSVLGTGWPKDLVKVEGDTVTFSFEMRSGREHNTPDKAMWGFACTVRAQESSEDVSGGLPFLVDLALGLSVLACSMLRILYNGPEITKEEEACQELLRSKLLQRCQWQVEANGVISPALTPSPSPLPLTIEEDREFTYPSDVLVPPVGNYFDLPRIRLPPGIMIKLREISGRARPQFRPSIKYVAV

SEQ ID NO: 946 - protein, 267 aa, Homo sapiens
MHYIKTWSLLGEMSEKLRRCRKELTAAIDRAFEGVSYSQECTGQQRLELSAAPLSFSLPVHRLLCRRHPLAACSSAAPFAAVPCAPENENPAFATNHAPVNAKPHALCPERKPLTSKENVLMHSSILAPERESWRTAGEGENWRKENLRKDMERDLKADSNMPLNNSSQEVTKDLLDMIDHTSIRTIEELAGKIEFENELNHMCGHCQDSPFKEEAWALLMDKSPQKATDADPGSLKQAFDDHNIVETVLDLEEDYNVMTSFKYQIE

SEQ ID NO: 947 - protein, 1243 aa, Homo sapiens
MENCSAASTFLTDSLELELGTEWCKPPYFSCAVDNRGGGKHFSGESYLCSGALKRLILNLDPLPTNFEEDTLEIFGIQWVTETALVNSSRELFHLFRQQLYNLETLLQSSCDFGKVSTLHCKADNIRQQCVLFLHYVKVFIFRYLKVQNAESHVPVHPYEALEAQLPSVLIDELHGLLLYIGHLSELPSVNIGAFVNQNQIKLFPPSWHLLHLHLDIHWLVLEILYMLGEKLKQVVYGHQFMNLASDNLTNISLFEEHCETLLCDLISLSLNRYDKVRSSESLMSDQCPCLRIKELWVLLIHLLDHRSKWFVSESFWNWLNKLLKTLLEKSSDRRRSSMPVIQSRDPLGFSWWIITHVASFYKFDRHGVPDEMRKVESNWNFVEELLKKSISVQGVILEEQLRMYLHCCLTLCDFWEPNIAIVTILWEYYSKNLNSSFSISWLPFKGLANTMKSPLSMLEMVKTCCCDKQDQELYKSSSSYTIFLCILAKVVKKAMKSNGPHPWKQVKGRIYSKFHQKRMEELTEVGLQNFFSLFLLLAAVAEVEDVASHVLDLLNFLKPAFVMSQRALIWKGHMAFLLMYAQKNLDIGVLAEKFSCAFREKAKEFLVSKNEEMVQRQTIWTLLSIYIDGVQEVFETSYCLYPSHEKLLNDGFSMLLRACRESELRTVLSFLQAVLARIRSMHQQLCQELQRDNVDLFVQSSLSAKERHLAAVASALWRHFFSFLKSQRMSQVVPFSQLADAAADFTLLAMDMPSTAPSDFQPQPVISIIQLFGWDDIICPQVVARYLSHVLQNSTLCEALSHSGYVSFQALTVRSWIRCVLQMYIKNLSGPDDLLIDKNLEEAVEKEYMKQLVKLTRLLFNLSEVKSIFSKAQAEYLSISEDPKKALVRFFEAVGVTYGNVQTLSDKSAMVTKSLEYLGEVLKYIKPYLGKKVFSAGLQLTYGMMGILVKSWAQIFATSKAQKLLFRIIDCLLLPHAVLQQEKELPAPMLSAIQKSLPLYLQGMCIVCCQSQNPNAYLNQLLGNVIEQYIGRFLPASPYVSDLGQHPVLLALRNTATIPPISSLKKCIVQVIRKSYLEYKGSSPPPRLASILAFILQLFKETNTDIYEVELLLPGILKCLVLVSEPQVKRLATENLQYMVKACQVGSEEEPSSQLTSVFRQFIQDYGMRYYYQVYSILETVATLDQQVVIHLISTLTQSLKDSEQKWGLGRNIAQREAYSKLLSHLGQMGQDEMQRLENDNT

SEQ ID NO: 948 - protein, 379 aa, Homo sapiens
MTLQPRCEDVETAEGVALTVTGVAQVKIMTEKELLAVACEQFLGKNVQDIKNVVLQTLEGHLRSILGTLTVEQIYQDRDQFAKLVREVAAPDVGRMGIEILSFTIKDVYDKVDYLSSLGKTQTAVVQRDADIGVAEAERDAGIREAECKKEMLDVKFMADTKIADSKRAFELQKSAFSEEVNIKTAEAQLAYELQGAREQQKIRQEEIEIEVVQRKKQIAVEAQEILRTDKELIATVRRPAEAEAHRIQQIAEGEKVKQVLLAQAEAEKIRKIGEAEAAVIEAMGKAEAERMKLKAEAYQKYGDAAKMALVLEALPQIAAKIAAPLTKVDEIVVLSGDNSKVTSEVNRLLAELPASVHALTGVDLSKIPLIKKATGVQV

SEQ ID NO: 949 - protein, 2584 aa, Homo sapiens
SQPTSVMLLDFIQHIMKSSPLMFVNVSGSHEAKGSCIEFSNWIITRLLRIAATPSCHLLHKKICEVICSLLFLFKSKSPAIFGVLTKELLQLFEDLVYLHRRNVMGHAVEWPVVMSRFLSQLDEHMGYLQSAPLQLMSMQNLEFIEVTLLMVLTRIIAIVFFRRQELLLWQIGCVLLEYGSPKIKSLAISFLTELFQLGGLPAQPASTFFSSFLELLKHLVEMDTDQLKLYEEPLSKLIKTLFPFEAEAYRNIEPVYLNMLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEEIKHVDMNQKSILWSALKQKAESLQISLEYSGLKNPVIEMLEGIAVVLQLTALCTVHCSHQNMNCRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKILIDKVKDDSDIVKKEFASILGQLVCTLHGMFYLTSSLTEPFSEHGHVDLFCRNLKATSQHECSSSQLKASVCKPFLFLLKKKIPSPVKLAFIDNLHHLCKHLDFREDETDVKAVLGTLLNLMEDPDKDVRVAFSGNIKHILESLDSEDGFIKELFVLRMKEAYTHAQISRNNELKDTLILTTGDIGRAAKGDLVPFALLHLLHCLLSKSASVSGAAYTEIRALVAAKSVKLQSFFSQYKKPICQFLVESLHSSQMTALPNTPCQNADVRKQDVAHQREMALNTLSEIANVFDFPDLNRFLTRTLQVLLPDLAAKASPAASALIRTLGKQLNVNRREILINNFKYIFSHLVCSCSKDELERALHYLKNETEIELGSLLRQDFQGLHNELLLRIGEHYQQVFNGLSILASFASSDDPYQGPRDIISPELMADYLQPKLLGILAFFNMQLLSSSVGIEDKKMALNSLMSLMKLMGPKHVSSVRVKMMTTLRTGLRFKDDFPELCCRAWDCFVRCLDHACLGSLLSHVIVALLPLIHIQPKETAAIFHYLIIENRDAVQDFLHEIYFLPDHPELKKIKAVLQEYRKETSESTDLQTTLQLSMKAIQHENVDVRIHALTSLKETLYKNQEKLIKYATDSETVEPIISQLVTVLLKGCQDANSQARLLCGECLGELGAIDPGRLDFSTTETQGKDFTFVTGVEDSSFAYGLLMELTRAYLAYADNSRAQDSAAYAIQELLSIYDCREMETNGPGHQLWRRFPEHVREILEPHLNTRYKSSQKSTDWSGVKKPIYLSKLGSNFAEWSASWAGYLITKVRHDLASKIFTCCSIMMKHDFKVTIYLLPHILVYVLLGCNQEDQQEVYAEIMAVLKHDDQHTINTQDIASDLCQLSTQTVFSMLDHLTQWARHKFQALKAEKCPHSKSNRNKVDSMVSTVDYEDYQSVTRFLDLIPQDTLAVASFRSKAYTRAVMHFESFITEKKQNIQEHLGFLQKLYAAMHEPDGVAGVSAIRKAEPSLKEQILEHESLGLLRDATACYDRAIQLEPDQIIHYHGVVKSMLGLGQLSTVITQVNGVHANRSEWTDELNTYRVEAAWKLSQWDLVENYLAADGKSTTWSVRLGQLLLSAKKRDITAFYDSLKLVRAEQIVPLSAASFERGSYQRGYEYIVRLHMLCELEHSIKPLFQHSPGDSSQEDSLNWVARLEMTQNSYRAKEPILALRRALLSLNKRPDYNEMVGECWLQSARVARKAGHHQTAYNALLNAGESRLAELYVERAKWLWSKGDVHQALIVLQKGVELCFPENETPPEGKNMLIHGRAMLLVGRFMEETANFESNAIMKKYKDVTACLPEWEDGHFYLAKYYDKLMPMVTDNKMEKQGDLIRYIVLHFGRSLQYGNQFIYQSMPRMLTLWLDYGTKAYEWEKAGRSDRVQMRNDLGKINKVITEHTNYLAPYQFLTAFSQLISRICHSHDEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGENILFDSLTGECVHVDFNCLFNKGETFEVPEIVPFRLTHNMVNGMGPMGTEGLFRRACEVTMRLMRDQREPLMSVLKTFLHDPLVEWSKPVKGHSKAPLNETGEVVNEKAKTHVLDIEQRLQGVIKTRNRVTGLPLSIEGHVHYLIQEATDENLLCQMYLGWTPYM

SEQ ID NO: 950 - protein, 585 aa, Homo sapiens
MARPDPSAPPSLLLLLLAQLVGRAAAASKAPVCQEITVPMCRGIGYNLTHMPNQFNHDTQDEAGLEVHQFWPLVEIQCSPDLRFFLCTMYTPICLPDYHKPLPPCRSVCERAKAGCSPLMRQYGFAWPERMSCDRLPVLGRDAEVLCMDYNRSEATTAPPRPFPAKPTLPGPPGAPASGGECPAGGPFVCKCREPFVPILKESHPLYNKVRTGQVPNCAVPCYQPSFSADERTFATFWIGLWSVLCFISTSTTVATFLIDMDTFRYPERPIIFLSACYLCVSLGFLVRLVVGHASVACSREHNHIHYETTGPALCTIVFLLVYFFGMASSIWWVILSLTWFLAAAMKWGNEAIAGYGQYFHLAAWLIPSVKSITALALSSVDGDPVAGICYVGNQNLNSLRRFVLGPLVLYLLVGTLFLLAGFVSLFRIRSVIKQGGTKTDKLEKLMIRIGIFTLLYTVPASIVVACYLYEQHYRESWEAALTCACPGHDTGQPRAKPEYWVLMLKYFMCLVVGITSGVWIWSGKTVESWRRFTSRCCCRPRRGHKSGGAMAAGDYPEASAALTGRTGPPGPAATYHKQVSLSHV

SEQ ID NO: 951 - protein, 362 aa, Homo sapiens
PHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQNGIVPIVEPEILPDGDHDLKRCQYVTEKVLAAVYKALSDHHVYLEGTLLKPNMVTPGHACPIKYTPEEIAMATVTALRRTVPPAVPGVTFLSGGQSEEEASFNLNAINRCPLPRPWALTFSYGRALQASALNAWRGQRDNAGAATEEFIKRAEVNGLAAQGKYEGSGEDGGAAAQSLYIANHA

SEQ ID NO: 952 - protein, 476 aa, Homo sapiens
GAVEPMQIDVDPQEDPQNAPDVNYVVENPSLDLEQYAASYSGLMRIERLQFIADHCPTLRVEALKMALSFVQRTFNVDMYEEIHRKLSEATRELQNAPDAIPESGVEPPALDTAWVEATRKKALLKLEKLDTDLKNYKGNSIKESIRRGHDDLGDHYLDCGDLSNALKCYSRARDYCTSAKHVINMCPNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVKSPPREGSQGELTPANSQSRMSTNM

SEQ ID NO: 953 - protein, 398 aa, Homo sapiens
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELHRLGSHPAPARAQKPGSSGLAARGLCVLGEDNAPL

SEQ ID NO: 954 - protein, 319 aa, Homo sapiens
MSQQNTSGDCLFDGVNELMKTLQFAVHIPTFVLGLLLNLLAIHGFSTFLKNRWPDYAATSIYMINLAVFDLLLVLSLPFKMVLSQVQSPFPSLCTLVECLYFVSMYGSVFTICFISMDRFLAIRYPLLVSHLRSPRKIFGICCTIWVLVWTGSIPIYSFHGKVEKYMCFHNMSDDTWSAKVFFPLEVFGFLLPMGIMGFCCSRSIHILLGRRDHTQDWVQQKACIYSIAASLAVFVVSFLPVHLGFFLQFLVRNSFIVECRAKQSISFFLQLSMCFSNVNCCLDVFCYYFVIKEFRMNIRAHRPSRVQLVLQDTTISRG

SEQ ID NO: 955 - protein, 309 aa, Homo sapiens
MNGTYNTCGSSDLTWPPAIKLGFYAYLGVLLVLGLLLNSLALWVFCCRMQQWTETRIYMTNLAVADLCLLCTLPFVLHSLRDTSDTPLCQLSQGIYLTNRYMSISLVTAIAVDRYVAVRHPLRARGLRSPRQAAAVCAVLWVLVIGSLVARWLLGIQEGGFCFRSTRHNFNSMAFPLLGFYLPLAVVVFCSLKVVTALAQRPPTDVGQAEATRKAARMVWANLLVFVVCFLPLHVGLTVRLAVGWNACALLETIRRALYITSKLSDANCCLDAICYYYMAKEFQEASALAVAPSAKAHKSQDSLCVTLA

SEQ ID NO: 956 - protein, 441 aa, Homo sapiens
MAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 957 - protein, 907 aa, Homo sapiens
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 958 - protein, 874 aa, Homo sapiens
MEKLLRLCCWYSWLLLFYYNFQVRGVYSRSQDHPGFQVLASASHYWPLENVDGIHELQDTTGDIVEGKVNKGIYLKEEKGVTLLYYGRYNSSCISKPEQCGPEGVTFSFFWKTQGEQSRPIPSAYGGQVISNGFKVCSSGGRGSVELYTRDNSMTWEASFSPPGPYWTHVLFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPIITNLTEERKTFQSPGVILSYLQNVSLSLPSKSLSEQTALNLTKTFLKAVGEILLLPGWIALSEDSAVVLSLIDTIDTVMGHVSSNLHGSTPQVTVEGSSAMAEFSVAKILPKTVNSSHYRFPAHGQSFIQIPHEAFHRHAWSTVVGLLYHSMHYYLNNIWPAHTKIAEAMHHQDCLLFATSHLISLEVSPPPTLSQNLSGSPLITVHLKHRLTRKQHSEATNSSNRVFVYCAFLDFSSGEGVWSNHGCALTRGNLTYSVCRCTHLTNFAILMQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 959 - protein, 499 aa, Homo sapiens
MELSEPIVENGETEMSPEESWEHKEEISEAEPGGGSLGDGRPPEESAHEMMEEEEEIPKPKSVVAPPGAPKKEHVNVVFIGHVDAGKSTIGGQIMYLTGMVDKRTLEKYEREAKEKNRETWYLSWALDTNQEERDKGKTVEVGRAYFETEKKHFTILDAPGHKSFVPNMIGGASQADLAVLVISARKGEFETGFEKGGQTREHAMLAKTAGVKHLIVLINKMDDPTVNWSNERYEECKEKLVPFLKKVGFNPKKDIHFMPCSGLTGANLKEQSDFCPWYIGLPFIPYLDNLPNFNRSVDGPIRLPIVDKYKDMGTVVLGKLESGSICKGQQLVMMPNKHNVEVLGILSDDVETDTVAPGENLKIRLKGIEEEEILPGFILCDPNNLCHSGRTFDAQIVIIEHKSIICPGYNAVLHIHTCIEEVEITALICLVDKKSGEKSKTRPRFVKQDQVCIARLRTAGTICLETFKDFPQMGRFTLRDEGKTIAIGKVLKLVPEKD

SEQ ID NO: 960 - protein, 453 aa, Homo sapiens
MASSLPWLCIILWLENALGKLEVEGNFYSENVSRILDNLLEGYDNRLRPGFGGAVTEVKTDIYVTSFGPVSDVEMEYTMDVFFRQTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQRKMGYFMIQIYTPCIMTVILSQVSFWINKESVPARTVFGITTVLTMTTLSISARHSLPKVSYATAMDWFIAVCFAFVFSALIEFAAVNYFTNLQTQKAKRKAQFAAPPTVTISKATEPLEAEIVLHPDSKYHLKKRITSLSLPIVSSSEANKVLTRAPILQSTPVTPPPLPPAFGGTSKIDQYSRILFPVAFAGFNLVYWVVYLSKDTMEVSSSVE

SEQ ID NO: 961 - protein, 367 aa, Homo sapiens
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGEHVVALMPEVGSLQHARVLQYRELLDALPMDAYTHGCILHPELTTDSMIPKYATAEIRRHLANATTDLMKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 962 - protein, 357 aa, Homo sapiens
GDWSFLGNFLEEVHKHSTVVGKVWLTVLFIFRMLVLGTAAESSWGDEQADFRCDTIQPGCQNVCYDQAFPISHIRYWVLQIIFVSTPSLVYMGHAMHTVRMQEKRKLREAERAKEVRGSGSYEYPVAEKAELSCWEEGNGRIALQGTLLNTYVCSILIRTTMEVGFIVGQYFIYGIFLTTLHVCRRSPCPHPVNCYVSRPTEKNVFIVFMLAVAALSLLLSLAELYHLGWKKIRQRFVKPRQHMAKCQLSGPSVGIVQSCTPPPDFNQCLENGPGGKFFNPFSNNMASQQNTDNLVTEQVRGQEQTPGEGFIQVRYGQKPEVPNGVSPGHRLPHGYHSDKRRLSKASSKARSDDLSV

SEQ ID NO: 963 - protein, 970 aa, Homo sapiens
MDAAEPGLPPGPEGRKRYSDIFRSLDNLEISLGNVTLEMLAGDPLLSEDPEPDKTPTATVTNEASCWSGPSPEGPVPLTGEELDLRLIRTKGGVDAALEYAKTWSRYAKELLAWTEKRASYELEFAKSTMKIAEAGKVSIQQQSHMPLQYIYTLFLEHDLSLGTLAMETVAQQKRDYYQPLAAKRTEIEKWRKEFKEQWMKEQKRMNEAVQALRRAQLQYVQRSEDLRARSQGSPEDSAPQASPGPSKQQERRRRSREEAQAKAQEAEALYQACVREANARQQDLEIAKQRIVSHVRKLVFQGDEVLRRVTLSLFGLRGAQAERGPRAFAALAECCAPFEPGQRYQEFVRALRPEAPPPPPPAFSFQEFLPSLNSSPLDIRKKLSGPLPPRLDENSAEPGPWEDPGTGWRWQGTPGPTPGSDVDSVGGGSESRSLDSPTSSPGAGTRQLVKASSTGTESSDDFEERDPDLGDGLENGLGSPFGKWTLSSAAQTHQLRRLRGPAKCRECEAFMVSGTECEECFLTCHKRCLETLLILCGHRRLPARTPLFGVDFLQLPRDFPEEVPFVVTKCTAEIEHRALDVQGIYRVSGSRVRVERLCQAFENGRALVELSGNSPHDVSSVLKRFLQELTEPVIPFHLYDAFISLAKTLHADPGDDPGTPSPSPDVIRSLKTLLVQLPDSNYNTLRHLVAHLFRVAARFMENKMSANNLGIVFGPTLLRPPDGPRAASAIPVTCLLDSGHQAQLVEFLIVHYEQIFGMDELPQATEPPPQDFSPAPGPLTTSSQPPPPHLDPDSQPPVLASDPGPDPQHHSTLEQHPTATPTEIPTPQSDQREDVAEDTKDGGGEVSSQGPEDSLLGTQSRGHFSRQPCKYPRGGVRPVTHQLSSLALVASKLCEETPITSVPRGSLRGRGPSPAAASPEGSPLRRTPLPKHFEITQETARLLSKLDSEAVPRATCCPDVQPEEAEDHL

SEQ ID NO: 964 - protein, 3259 aa, Homo sapiens
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEDNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 965 - protein, 522 aa, Homo sapiens
MNINDLKLTLSKAGQEHLLRFWNELEEAQQVELYAELQAMNFEELNFFFQKAIEGFNQSSHQKNVDARMEPVPREVLGSATRDQDQLQAWESEGLFQISQNKVAVLLLAGGQGTRLGVAYPKGMYDVGLPSRKTLFQIQAERILKLQQVAEKYYGNKCIIPWYIMTSGRTMESTKEFFTKHKYFGLKKENVIFFQQGMLPAMSFDGKIILEEKNKVSMAPDGNGGLYRALAAQNIVEDMEQRGIWSIHVYCVDNILVKVADPRFIGFCIQKGADCGAKVVEKTNPTEPVGVVCRVDGVYQVVEYSEISLATAQKRSSDGRLLFNAGNIANHFFTVPFLRDVVNVYEPQLQHHVAQKKIPYVDTQGQLIKPDKPNGIKMEKFVFDIFQFAKKFVVYEVLREDEFSPLKNADSQNGKDNPTTARHALMSLHHCWVLNAGGHFIDENGSRLPAIPRSATNGKSETITADVNHNLKDANDVPIQCEISPLISYAGEGLESYVADKEFHAPLIIDENGVHELVKNGI

SEQ ID NO: 966 - protein, 944 aa, Homo sapiens
MAAVAAVAARRRRSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 967 - protein, 526 aa, Homo sapiens
MAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGLKLKFLDPNNIPKASMTSGLVQQFQHTVLPSVTPLATLICTLIAILPSIFCLWFKPQGPRGFLRCLTLCALSSFMFGWHVHEKAILLAILPMSLLSVGKAGDASIFLILTTTGHYSLFPLLFTAPELPIKILLMLLFTIYSISSLKTLFRKEKPLFNWMETFYLLGLGPLEVCCEFVFPFTSWKVKYPFIPLLLTSVYCAVGVTYAWFKLYVSVLIDSAIGKTKKQ

SEQ ID NO: 968 - protein, 1440 aa, Homo sapiens
MEHTEIDHWLEFSATKLSSCDSFTSTINELNHCLSLRTYLVGNSLSLADLCVWATLKGNAAWQEQLKQKKAPVHVKRWFGFLEAQQAFQSVGTKWDVSTTKARVAPEKKQDVGKFVELPGAEMGKVTVRFPPEASGYLHIGHAKAALLNQHYQVNFKGKLIMRFDDTNPEKEKEDFEKVILEDVAMLHIKPDQFTYTSDHFETIMKYAEKLIQEGKAYVDDTPAEQMKAEREQRIESKHRKNPIEKNLQMWEEMKKGSQFGHSCCLRAKIDMSSNNGCMRDPTLYRCKIQPHPRTGNKYNVYPTYDFACPIVDSIEGVTHALRTTEYHDRDEQFYWIIEALGIRKPYIWEYSRLNLNNTVLSKRKLTWFVNEGLVDGWDDPRFPTVRGVLRRGMTVEGLKQFIAAQGSSRSVVNMEWDKIWAFNKKVIDPVAPRYVALLKKEVIPVNVPEAQEEMKEVAKHPKNPEVGLKPVWYSPKVFIEGADAETFSEGEMVTFINWGNLNITKIHKNADGKIISLDAKFNLENKDYKKTTKVTWLAETTHALPIPVICVTYEHLITKPVLGKDEDFKQYVNKNSKHEELMLGDPCLKDLKKGDIIQLQRRGFFICDQPYEPVSPYSCKEAPCVLIYIPDGHTKEMPTSGSKEKTKVEATKNETSAPFKERPTPSLNNNCTTSEDSLVLYNRVAVQGDVVRELKAKKAPKEDVDAAVKQLLSLKAEYKEKTGQEYKPGNPPAEIGQNISSNSSASILESKSLYDEVAAQGEVVRKLKAEKSPKAKINEAVECLLSLKAQYKEKTGKEYIPGQPPLSQSSDSSPTRNSEPAGLETPEAKVLFDKVASQGEVVRKLKTEKAPKDQVDIAVQELLQLKAQYKSLIGVEYKPVSATGAEDKDKKKKEKENKSEKQNKPQKQNDGQRKDPSKNQGGGLSSSGAGEGQGPKKQTRLGLEAKKEENLADWYSQVITKSEMIEYHDISGCYILRPWAYAIWEAIKDFFDAEIKKLGVENCYFPMFVSQSALEKEKTHVADFAPEVAWVTRSGKTELAEPIAIRPTSETVMYPAYAKWVQSHRDLPIKLNQWCNVVRWEFKHPQPFLRTREFLWQEGHSAFATMEEAAEEVLQILDLYAQVYEELLAIPVVKGRKTEKEKFAGGDYTTTIEAFISASGRAIQGGTSHHLGQNFSKMFEIVFEDPKIPGEKQFAYQNSWGLTTRTIGVMTMVHGDNMGLVLPPRVACVQVVIIPCGITNALSEEDKEALIAKCNDYRRRLLSVNIRVRADLRDNYSPGWKFNHWELKGVPIRLEVGPRDMKSCQFVAVRRDTGEKLTVAENEAETKLQAILEDIQVTLFTRASEDLKTHMVVANTMEDFQKILDSGKIVQIPFCGEIDCEDWIKKTTARDQDLEPGAPSMGAKSLCIPFKPLCELQPGAKCVCGKNPAKYYTLFGRSY

SEQ ID NO: 969 - protein, 206 aa, Homo sapiens [sequence omitted]

SEQ ID NO: 970 - protein, 370 aa, Homo sapiens
MASSTTRGPRVSDLFSGLPPAVTTPANQSAEASAGNGSVAGADAPAVTPFQSLQLVHQLKGLIVLLYSVVVVVGLVGNCLLVLVIARVRRLHNVTNFLIGNLALSDVLMCTACVPLTLAYAFEPRGWVFGGGLCHLVFFLQPVTVYVSVFTLTTIAVDRYVVLVHPLRRRISLRLSAYAVLAIWALSAVLALPAAVHTYHVELKPHDVRLCEEFWGSQERQRQLYAWGLLLVTYLLPLLVILLSYVRVSVKLRNRVVPGCVTQSQADWDRARRRRTFCLLVVVVVVFAVCWLPLHVFNLLRDLDPHAIDPYAFGLVQLLCHWLAMSSACYNPFIYAWLHDSFREELRKLLVAWPRKIAPHGQNMTVSVVI

SEQ ID NO: 971 - protein, 3080 aa, Homo sapiens
  misc_feature (1213)..(1213): Xaa can be any naturally occurring amino acid
  misc_feature (1540)..(1540): Xaa can be any naturally occurring amino acid
  misc_feature (1791)..(1791): Xaa can be any naturally occurring amino acid
MKEHIIYQKLYGLILMSSFIFLSDTLSLKGKKLDFFGRGDTYVSLIDTIPELSRFTACIDLVFMDDNSRYWMAFSYITNNALLGREDIDLGLAGDHQQLILYRLGKTFSIRHHLASFQWHTICLIWDGVKGKLELFLNKERILEVTDQPHNLTPHGTLFLGHFLKNESSEVKSMMRSFPGSLYYFQLWDHILENEEFMKCLDGNIVSWEEDVWLVNKIIPTVDRTLRCFVPENMTIQEKSTTVSQQIDMTTPSQITGVKPQNTAHSSTLLSQSIPMFATDYTTISYSNTTSPPLETMTAQKILKTLVDETATFAVDVLSTSSAISLPTQSISIDNTTNSMKKTKSPSSESTKTTKMVEAMATEIFQPHTPSNFLSTSRFTKNSVVSTTSAIKSQSAVTKTTSLFSTIESTSMSTTPCLKQKSTNTGALPISTAGQEFIESTAAGTVPWFTVEKTSPASTHVGTASSFPPEPVLISTAAPVDSVFPRNQTAFPLATTDMKIAFTVHSLTLPTRLIETTPAPRTAETELTSTNFQDVSLPRVEDAMSTSMSKETSSKTFSFLTSFSFTGTESVQTVIDAEATRTALTPEITLASTVAETMLSSTITGRVYTQNTPTADGHLLTLMSTRSASTSKAPESGPTSTTDEAAHLFSSNETIWTSRPDQALLASMNTTTILTFVPNENFTSAFHENTTYTEYLSATTNITPLKASPEGKGTTANDATTARYTTAVSKLTSPWFANFSIVSGTTSITNMPEFKLTTLLLKTIPMSTKPANELPLTPRETVVPSVDIISTLACIQPNFSTEESASETTQTEINGAIVFGGTTTPVPKSATTQRLNATVTRKEATSHYLMRKSTIAAVAEVSPFSTMLEVTDESAQRVTASVTVSSFPDIEKLSTPLDNKTATTEVRESWLLTKLVKTTPRSSYNEMTEMFNFNHTYVAHWTSETSEGISAGSPTSGSTHIFGEPLGASTTRISETSFSTTPTDRTATSLSDGILPPQPTAAHSSATPVPVTHMFSLPVNGSSVVAEETEVTMSEPSTLARAFSTSVLSDVSNLSSTTMTTALVPPLDQTASTTIVIVPTHGDLIRTTSEATVISVRKTSMAVPSLTETPFHSLRLSTPVTAKAETTLFSTSVDTVTPSTHTLVCSKPPPDNIPPASSTHVISTTSTPEATQPISQVEETSTYALSFPYTFSGGGVVASLATGTTETSVVDEXTPSHISANKLTTSVNSHISSSATYRVHTPVSIQLVTSTSVLSSDKDQMTISLGKTPRTMEVTEMSPSKNSFISYSRGTPSLEMTDTGFPETTKISSHQTHSPSEIPLGTPSDGNLASSPTSGSTQITPTLTSSNTVGVHIPEMSTSLGKTALPSQALTITTFLCPEKESTSALPAYTPRTVEMIVNSTYVTHSVSYGQDTSFVDTTTSSSTRISNPMDINTTFSHLHSLRTQPEVTSVASFISESTQTFPESLSLSTAGLYNDGFTVLSDRITTAFSVPNVPTMLPRESSMATSTPIYQMSSLPVNVTAFTSKKVSDTPPIVITKSXKTMHPGCLKSPCTATSGPMSEMSSIPVNNSAFTPATVSSDTSTRVGLFSTLLSSVTPRTTMTMQTSTLDVTPVIYAGATSKNKMVSSAFTTEMIEAPSRITPTTFLSPTEPTLPFVKTVPTTIMAGIVTPFVGTTAFSPLSSKSTGAISSIPKTTFSPFLSATQQSSQADEATTLGILSGITNRSLSTVNSGTGVALTDTYSRITVPENMLSPTHADSLHTSFNIQVSPSLTSFKSASGPTKNVKTTTNCXSSNTRKMTSLLEKTSLTNYATSLNTPVSYPPWTPSSATLPSLTSFVYSPHSTEAEISTPKTSPPPTSQMVEFPVLGTRMTSSNTQPLLMTSWNIPTAEGSQFPISTTINVPTSNEMETETLHLVPGPLSTFTASQTGLVSKDVMAMSSIPMSGILPNHGLSENPSLSTSLRAITSTLADVKHTFEKMTTSVTPGTTLPSILSGATSGSVISKSPILTWLLSSLPSGSPPATVSNAPHVMTSSTVEVSKSTFLTSDMISAHPFTNLTTLPSATMSTILTRTIPTPTLGGITTGFPTSLPMSINVTDDIVYISTHPEASSRTTITANPRTVSHPSSFSRKTMSPSTTDHTLSVGAMPLPSSTITSSWNRIPTASSPSTLIIPKPTLDSLLNIMTTTSTVPGASFPLISTGVTYPFTATVSSPISSFFETTWLDSTPSFLSTEASTSPTATKSTVSFYNVEMSFSVFVEEPRIPITSVINEFTENSLNSIFQNSEFSLATLETQIKSRDISEEEMVMDRAILEQREGQEMATISYVPYSCVCQVIIKASSSLASSELMRKIKSKIHGNFTHGNFTQDQLTLLVNCEHVAVKKLEPGNCKADETASKYKGTYKWLLTNPTETAQTRCIKNEDGNATRFCSISINTGKSQWEKPKFKQCKLLQELPDKIVDLANITISDENAEDVAEHILNLINESPALGKEETKIIVSKISDISQCDEISMNLTHVMLQIINVVLEKQNNSASDLHEISNEILRIIERTGHKMEFSGQIANLTVAGLALAVLRGDHTFDGMAFSIHSYEEGTDPEIFLGNVPVGGILASIYLPKSLTERIPLSNLQTILFNFFGQTSLFKTKNVTKALTTYVVSASISDDMFIQNLADPVVITLQHIGGNQNYGQVHCAFWDFENNNGLGGWNSSGCKVKETNVNYTICQCDHLTHFGVLMDLSRSTVDSVNEQILALITYTGCGISSIFLGVAVVTYIAFHKLRKDYPAKILINLCTALLMLNLVFLINSWLSSFQKVGVCITAAVALHYFLLVSFTWMGLEAVHMYLALVKVFNIYIPNYILKFCLVGWGIPAIMVAITVSVKKDLYGTLSPTTPFCWIKDDSIFYISVVAYFCLIFLMNLSMFCTVLVQLNSVKSQIQKTRRKMILHDLKGTMSLTFLLGLTWGFAFFAWGPMRNFFLYLFAIFNTLQGFFIFVFHCVMKESVREQWQIHLCCGWLRLDNSSDGSSRCQIKVGYKQEGLKKIFEHKLLTPSLKSTATSSTFKSLGSAQGTPSEISFPNDDFDKDPYCSSP

SEQ ID NO: 972 - protein, 540 aa, Homo sapiens
MTTSLQDGQSAASRAAARDSPLAAQVCGAAQGRGDAHDLAPAPWLHARALLPLPDGTRGCAADRRKKKDLDVPEMPSIPNPFPELCCSPFTSVLSADLFPKANSRKKQVIKVYSEDETSRALDVPSDITARDVCQLLILKNHYIDDHSWTLFEHLPHIGVERTIEDHELVIEVLSNWGIEEENKLYFRKNYAKYEFFKNPMYFFPEHMVSFATETNGEISPTQILQMFLSSSTYPEIHGFLHAKEQGKKSWKKIYFFLRRSGLYFSTKGTSKEPRHLQFFSEFGNSDIYVSLAGKKKHGAPTNYGFCFKPNKAGGPRDLKMLCAEEEQSRTCWVTAIRLLKYGMQLYQNYMHPYQGRSGCSSQSISPMRSISENSLVAMDFSGQKSRVIENPTEALSVAVEEGLAWRKKGCLRLGTHGSPTASSQSSATNMAIHRSQPWFHHKISRDEAQRLIIQQGLVDGVFLVRDSQSNPKTFVLSMSHGQKIKHFQIIPVEDDGEMFHTLDDGHTRFTDLIQLVEFYQLNKGVLPCKLKHYCARIAL

SEQ ID NO: 973 - protein, 1583 aa, Homo sapiens
MKQEVEDSVTKMGDAHKELEQSHINYVKEIENLKNELMAVRSKYSEDKANLQKQLEEAMNTQLELSEQLKFQNNSEDNVKKLQEEIEKIRPGFEEQILYLQKQLDATTDEKKETVTQLQNIIEANSQHYQKNINSLQEELLQLKAIHQEEVKELMCQIEASAKEHEAEINKLNELKENLVKQCEASEKNIQKKYECELENLRKATSNANQDNQICSILLQENTFVEQVVNEKVKHLEDTLKELESQHSILKDEVTYMNNLKLKLEMDAQHIKDEFFHEREDLEFKINELLLAKEEQGCVIEKLKSELAGLNKQFCYTVEQHNREVQSLKEQHQKEISELNETFLSDSEKEKLTLMFEIQGLKEQCENLQQEKQEAILNYESLREIMEILQTELGESAGKISQEFESMKQQQASDVHELQQKLRTAFTEKDALLETVNRLQGENEKLLSQQELVPELENTIKNLQEKNGVYLLSLSQRDTMLKELEGKINSLTEEKDDFINKLKNSHEEMDNFHKKCEREERLILELGKKVEQTIQYNSELEQKVNELTGGLEETLKEKDQNDQKLEKLMVQMKVLSEDKEVLSAEVKSLYEENNKLSSEKKQLSRDLEVFLSQKEDVILKEHITQLEKKLQLMVEEQDNLNKLLENEQVQKLFVKTQLYGFLKEMGSEVSEDSEEKDVVNVLQAVGESLAKINEEKCNLAFQRDEKVLELEKEIKCLQEESVVQCEELKSLLRDYEQEKVLLRKELEEIQSEKEALQSDLLEMKNANEKTRLENQNLLIQVEEVSQTCSKSEIHNEKEKCFIKEHENLKPLLEQKELRDRRAELILLKDSLAKSPSVKNDPLSSVKELEEKIENLEKECKEKEEKINKIKLVAVKAKKELDSSRKETQTVKEELESLRSEKDQLSASMRDLIQGAESYKNLLLEYEKQSEQLDVEKERANNFEHRIEDLTRQLRNSTLQCETINSDNEDLLARIETLQSNAKLLEVQILEVQRAKAMVDKELEAEKLQKEQKIKEHATTVNELEELQVQLQKEKKQLQKTMQELELVKKDAQQTTLMNMEIADYERLMKELNQKLTNKNNKIEDLEQEIKIQKQKQETLQEEITSLQSSVQQYEEKNTKIKQLLVKTKKELADSKQAETDHLILQASLKGELEASQQQVEVYKIQLAEITSEKHKIHEHLKTSAEQHQRTLSAYQQRVTALQEECRAAKAEQATVTSEFESYKVRVHNVLKQQKNKSMSQAETEGAKQEREHLEMLIDQLKIKLQDSQNNLQINVSELQTLQSEHDTLLERHNKMLQETVSKEAELREKLCSIQSENMMMKSEHTQTVSQLTSQNEVLRNSFRDQVRHLQEEHRKTVETLQQQLSKMEAQLFQLKNEPTTRSPVSSQQSLKNLRERRNTDLPLLDMHTVTREEGEGMETTDTESVSSASTYTQSLEQLLNSPETKLEPPLWHAEFTKEELVQKLSSTTKSADHLNGLLRETEATNAILMEQIKLLKSEIRRLERNQEREKSAANLEYLKNVLLQFIFLKPGSERERLLPVINTMLQLSPEEKGKLAAVAQGEEENASRSSGWASYLHSWSGLR

SEQ ID NO: 974 - protein, 736 aa, Homo sapiens [sequence omitted]

SEQ ID NO: 975 - protein, 366 aa, Homo sapiens
MWNATPSEEPGFNLTLADLDWDASPGNDSLGDELLQLFPAPLLAGVTATCVALFVVGIAGNLLTMLVVSRFRELRTTTNLYLSSMAFSDLLIFLCMPLDLVRLWQYRPWNFGDLLCKLFQFVSESCTYATVLTITALSVERYFAICFPLRAKVVVTKGRVKLVIFVIWAVAFCSAGPIFVLVGVEHENGTDPWDTNECRPTEFAVRSGLLTVMVWVSSIFFFLPVFCLTVLYSLIGRKLWRRRRGDAVVGASLRDQNHKQTVKMLAVVVFAFILCWLPFHVGRYLFSKSFEPGSLEIAQISQYCNLVSFVLFYLSAAINPILYNIMSKKYRVAVFRLLGFEPFSQRKLSTLKDESSRAWTESSINT

SEQ ID NO: 976 - protein, 222 aa, Homo sapiens
MAARPKLHYPNGRGRMESVRWVLAAAGVEFDEEFLETKEQLYKLQDGNHLLFQQVPMVEIDGMKLVQTRSILHYIADKHNLFGKNLKERTLIDMYVEGTLDLLELLIMHPFLKPDDQQKEVVNMAQKAIIRYFPVFEKILRGHGQSFLVGNQLSLADVILLQTILALEEKIPNILSAFPFLQEYTVKLSNIPTIKRFLEPGSKKKPPPDEIYVRTVYNIFRP

SEQ ID NO: 977 - protein, 266 aa, Homo sapiens
MMKTLSSGNCTLSVPAKNSYRMVVLGASRVGKSSIVSRFLNGRFEDQYTPTIEDFHRKVYNIRGDMYQLDILDTSGNHPFPAMRRLSILTGDVFILVFSLDNRESFDEVKRLQKQILEVKSCLKNKTKEAAELPMVICGNKNDHGELCRQVPTTEAELLVSGDENCAYFEVSAKKNTNVDEMFYVLFSMAKLPHEMSPALHRKISVQYGDAFHPRPFCMRRVKEMDAYGMVSPFARRPSVNSDLKYIKAKVLREGQARERDKCTIQ

SEQ ID NO: 978 - protein, 219 aa, Homo sapiens
MDSGTRPVGSCCSSPAGLSREYKLVMLGAGGVGKSAMTMQFISHRFPEDHDPTIEDAYKIRIRIDDEPANLDILDTAGQAEFTAMRDQYMRAGEGFIICYSITDRRSFHEVREFKQLIYRVRRTDDTPVVLVGNKSDLKQLRQVTKEEGLALAREFSCPFFETSAAYRYYIDDVFHALVREIRRKEKEAVLAMEKKSKPKNSVWKRLKSPFRKKKDSVT

SEQ ID NO: 979 - protein, 380 aa, Homo sapiens
MVGFGANRRAGRLPSLVLVVLLVVIVVLAFNYWSISSRHVLLQEEVAELQGQVQRTEVARGRLEKRNSDLLLLVDTHKKQIDQKEADYGRLSSRLQAREGLGKRCEDDKVKLQNNISYQMADIHHLKEQLAELRQEFLRQEDQLQDYRKNNTYLVKRLEYESFQCGQQMKELRAQHEENIKKLADQFLEEQKQETQKIQSNDGKELDINNQVVPKNIPKVAENVADKNEEPSSNHIPHGKEQIKRGGDAGMPGIEENDLAKVDDLPPALRKPPISVSQHESHQAISHLPTGQPLSPNMPPDSHINHNGNPGTSKQNPSSPLQRLIPGSNLDSEPRIQTDILKQATKDRVSDFHKLKQNDEERELQMDPADYGKQHFNDVL

SEQ ID NO: 980 - protein, 1268 aa, Homo sapiens [sequence omitted]

SEQ ID NO: 981 - protein, 704 aa, Homo sapiens
MARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 982 - protein, 839 aa, Homo sapiens
MSVVGIDLGFLNCYIAVARSGGIETIANEYSDRCTPACISLGSRTRAIGNAAKSQIVTNVRNTIHGFKKLHGRSFDDPIVQTERIRLPYELQKMPNGSAGVKVRYLEEERPFAIEQVTGMLLAKLKETSENALKKPVADCVISIPSFFTDAERRSVMAAAQVAGLNCLRLMNETTAVALAYGIYKQDLPPLDEKPRNVVFIDMGHSAYQVSVCAFNKGKLKVLATTFDPYLGGRNFDEALVDYFCDEFKTKYKINVKENSRALLRLYQECEKLKKLMSANASDLPLNIECFMNDLDVSSKMNRAQFEQLCASLLARVEPPLKAVMEQANLQREDISSIEIVGGATRIPAVKEQITKFFLKDISTTLNADEAVARGCALQCAILSPAFKVREFSITDLVPYSITLRWKTSFEDGSGECEVFCKNHPAPFSKVITFHKKEPFELEAFYTNLHEVPYPDARIGSFTIQNVFPQSDGDSSKVKVKVRVNIHGIFSVASASVIEKQNLEGDHSDAPMETETSFKNENKDNMDKMQVDQEEGHQKCHAEHTPEEEIDHTGAKTKSAVSDKQDRLNQTLKKGKVKSIDLPIQSSLCRQLGQDLLNSYIENEGKMIMQDKLEKERNDAKNAVEEYVYDFRDRLGTVYEKFITPEDLSKLSAVLEDTENWLYEDGEDQPKQVYVDKLQELKKYGQPIQMKYMEHEERPKALNDLGKKIQLVMKVIEAYRNKDERYDHLDPTEMEKVEKCISDAMSWLNSKMNAQNKLSLTQDPVVKVSEIVAKSKELDNFCNPIIYKPKPKAEVPEDKPKANSERNGPMDGQSGTETKSDSTKDSSQHTKSSGEMEVD

SEQ ID NO: 983 - protein, 802 aa, Homo sapiens
MRALWVLGLCCVLLTFGSVRADDEVDVDGTVEEDLGKSREGSRTDDEVVQREEEAIQLDGLNASQIRELREKSEKFAFQAEVNRMMKLIINSLYKNKEIFLRELISNASDALDKIRLISLTDENALSGNEELTVKIKCDKEKNLLHVTDTGVGMTREELVKNLGTIAKSGTSEFLNKMTEAQEDGQSTSELIGQFGVGFYSAFLVADKVIVTSKHNNDTQHIWESDSNEFSVIADPRGNTLGRGTTITLVLKEEASDYLELDTIKNLVKKYSQFINFPIYVWSSKTETVEEPMEEEEAAKEEKEESDDEAAVEEEEEEKKPKTKKVEKTVWDWELMNDIKPIWQRPSKEVEEDEYKAFYKSFSKESDDPMAYIHFTAEGEVTFKSILFVPTSAPRGLFDEYGSKKSDYIKLYVRRVFITDDFHDMMPKYLNFVKGVVDSDDLPLNVSRETLQQHKLLKVIRKKLVRKTLDMIKKIADDKYNDTFWKEFGTNIKLGVIEDHSNRTRLAKLLRFQSSHHPTDITSLDQYVERMKEKQDKIYFMAGSSRKEAESSPFVERLLKKGYEVIYLTEPVDEYCIQALPEFDGKRFQNVAKEGVKFDESEKTKESREAVEKEFEPLLNWMKDKALKDKIEKAVVSQRLTESPCALVASQYGWSGNMERIMKAQAYQTGKDISTNYYASQKKTFEINPRHPLIRDMLRRIKEDEDDKTVLDLAVVLFETATLRSGYLLPDTKAYGDRIERMLRLSLNIDPDAKVEEEPEEEPEETAEDTTEDTEQDEDEEMDVGTDEEETAKESTAEKDEL

SEQ ID NO: 984 - protein, 150 aa, Homo sapiens
MAKIILRHLIEIPVRYQEEFEARGLEDCRLDHALYALPGPTIVDLRKTRAAQSPPVDSAAETPPREGKSHFQILLDVVQFLPEDIIIQTFEGWLLIKAQHGTRMDEHGFISRSFTRQYKLPDGVEIKDLSAVLCHDGILVVEVKDPVGTK

SEQ ID NO: 985 - protein, 1615 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 986 - protein, 1400 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQGCGAEDVVPFQCPACDFQRCQACWQRHLQASRMCPACHTASRKQSVMQVFWPEPHKDHEGAGGARPVAAVPGVGAACPAAGAGCTRSGRNTHLPLAGRRDRGAAGVCPVPPRHLCAAAVPPRQPHDVWPVSTAPLHAVLELPGALPLLQRPLRGA

SEQ ID NO: 987 - protein, 1127 aa, Homo sapiens
MSLTSAYQHKLAEKLTILNDRGQGVLIRMYNIKKTCSDPKSKPPFLLEKSMEPSLKYINKKFPNIDVRNSTQHLGPVHREKAEIIRFLTNYYQSFVDVMEFRDHVYELLNTIDACQCHFDINLNFDFTRSYLDLIVTYTSVILLLSRIEDRRILIGMYNCAHEMLHGHGDPSFARLGQMVLEYDHPLKKLTEEFGPHTKAVSGALLSLHFLFVRRNQGAEQWRSAQLLSLISNPPAMINPANSDTMACEYLSVEVMERWIIIGFLLCHGCLNSNSQCQKLWKLCLQGSLYITLIREDVLQVHKVTEDLFSSLKGYGKRVADIKESKEHVIANSGQFHCQRRQFLRMAVKELETVLADEPGLLGPKALFAFMALSFIRDEVTWLVRHTENVTKTKTPEDYADSSIAELLFLLEGIRSLVRRHIKVIQQYHLQYLARFDALVLSDIIQNLSVCPEEESIIMSSFVSILSSLNLKQVDNGEKFEFSGLRLDWFRLQAYTSVAKAPLHLHENPDLAKVMNLIVFHSRMLDSVEKLLVETSDLSTFCFHLRIFEKMFAMTLEESAMLRYAIAFPLICAHFVHCTHEMCPEEYPHLKNHGLHHCNSFLEELAKQTSNCVLEICAEQRNLSEQLLPKHCATTISKAKNKKTRKQRQTPRKGEPERDKPGAESHRKNRSIVTNMDKLHLNLTELALTMNHVYSFSVFEHTIFPSEYLSSHLEARLNRAIVWLAGYNATTQEIVRPSELLAGVKAYIGFIQSLAQFLGADASRVIRNALLQQTQPLDSCGEQTITTLYTNWYLESLLRQASSGTIILSPAMQAFVSLPREGEQNFSAEEFSDISEMRALAELLGPYGMKFLSENLMWHVTSQIVELKKLVVENMDILVQIRSNFSKPDLMASLLPQLTGAENVLKRMTIIGVILSFRAMAQEGLREVFSSHCPFLMGPIECLKEFVTPDTDIKVTLSIFELASAAGVGCDIDPALVAAIANLKADTSSPEEEYKVACLLLIFLAVSLPLLATDPSSFYSIEKDGYNNNIHCLTKAIIQVSAALFTLYNKNIETHLKEFLVVASVSLLQLGQETDKLKTRNRESISLLMRLVVEESSFLTLDMLESCFPYVLLRNAYREVSRAFHLN

SEQ ID NO: 988 - protein, 288 aa, Homo sapiens
MERPQPDSMPQDLSEALKEATKEVHTQAENAEFMRNFQKGQVTRDGFKLVMASLYHIYVALEEEIERNKESPVFAPVYFPEELHRKAALEQDLAFWYGPRWQEVIPYTPAMQRYVKRLHEVGRTEPELLVAHAYTRYLGDLSGGQVLKKIAQKALDLPSSGEGLAFFTFPNIASATKFKQLYRSRMNSLEMTPAVRQRVIEEAKTAFLLNIQLFEELQELLTHDTKDQSPSRAPGLRQRASNKVQDSAPVETPRGKPPLNTRSQAPLLRWVLTLSFLVATVAVGLYAM

SEQ ID NO: 989 - protein, 346 aa, Homo sapiens
MLFKQQAWLRQKLLVLGSLAVGSLLYLVARVGSLDRLQPICPIEGRLGGARTQAEFPLRALQFKRGLLHEFRKGNASKEQVRLHDLVQQLPKAIIIGVRKGGTRALLEMLNLHPAVVKASQEIHFFDNDENYGKGIEWYRKKMPFSYPQQITIEKSPAYFITEEVPERIYKMNSSIKLLIIVREPTTRAISDYTQVLEGKERKNKTYYKFEKLAIDPNTCEVNTKYKAVRTSIYTKHLERWLKYFPIEQFHVVDGDRLITEPLPELQLVEKFLNLPPRISQYNLYFNATRGFYCLRFNIIFNKCLAGSKGRIHPEVDPSVITKLRKFFHPFNQKFYQITGRTLNWP

SEQ ID NO: 990 - protein, 597 aa, Homo sapiens
MAEIIQERIEDRLPELEQLERIGLFSHAEIKAIIKKASDLEYKIQRRTLFKEDFINYVQYEINLLELIRRRRTRIGYSFKKDEIENSIVHRVQGVFQRASAKWKDDVQLWLSYVAFCKKWATKTRLSKVFSAMLAIHSNKPALWIMAAKWEMEDRLSSESARQLFLRALRFHPECPKLYKEYFRMELMHAEKLRKEKEEFEKASMDVENPDYSEEILKGELAWIIYKNSVSIIKGAEFHVSLLSIAQLFDFAKDLQKEIYDDLQALHTDDPLTWDYVARRELEIESQTEEQPTTKQAKAVEVGRKEERCCAVYEEAVKTLPTEAMWKCYITFCLERFTKKSNSGFLRGKRLERTMTVFRKAHELKLLSECQYKQLSVSLLCYNFLREALEVAVAGTELFRDSGTMWQLKLQVLIESKSPDIAMLFEEAFVHLKPQVCLPLWISWAEWSEGAKSQEDTEAVFKKALLAVIGADSVTLKNKYLDWAYRSGGYKKARAVFKSLQESRPFSVDFFRKMIQFEKEQESCNMANIREYYERALREFGSADSDLWMDYMKEELNHPLGRPENCGQIYWRAMKMLQGESAEAFVAKHAMHQTGHL

SEQ ID NO: 991 - protein, 523 aa, Homo sapiens
MSLVSQNARHCSAEITADYGDGRGEIQATNASGSPTSMLVVDAPQCPQAPINSQCVNTSQAVQDPNDLEVLIDEQSRRLGALRVHDPLEDRSIALVNFMRMKSQTEGSIQQSEMLEFLREYSDQFPEILRRASAHLDQVFGLNLRVIDPQADTYNLVSKRGFQITDRIAESLDMPKASLLALVLGHILLNGNRAREASIWDLLLKVDMWDKPQRINNLFGNTRNLLTTDFVCMRFLEYWPVYGTNPLEFEFLWGSRAHREITKMEALKFVSDAHDEEPWSWPEEYNKALEGDKTKERSLTAGLEFWSEDTMNDKANDLVQLAISVTEEMLPIHQDELLAHTGKEFEDVFPNILNRATLILDMFYGLSLIEVDTSEHIYLLVQQPESEEEQVMLESLGRPTQEYVMPILGLIFLMGNRVKEANVWNLLRRFSVDVGRKHSITRKLMRQRYLECRPLSYSNPVEYELLWGPRAHHETIKMKVLEYMARLYRKRPQNWPEQYREAVEDEEARAKSEATIMFFLDPT

SEQ ID NO: 992 - protein, 226 aa, Homo sapiens
MEGCVSNLMVCNLAYSGKLEELKESILADKSLATRTDQDSRTALHWACSAGHTEIVEFLLQLGVPVNDKDDAGWSPLHIAASAGRDEIVKALLGKGAQVNAVNQNGCTPLHYAASKNRHEIAVMLLEGGANPDAKDHYEATAMHRAAAKGNLKMIHILLYYKASTNIQDTEGNTPLHLACDEERVEEAKLLVSQGASIYIENKEEKTPLQVAKGGLGLILKRMVEG

SEQ ID NO: 993 - protein, 891 aa, Homo sapiens
MHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 994 - protein, 4834 aa, Homo sapiens
MPSESFCLAAQARLDSKWLKTDIQLAFTRDGLCGLWNEMVKDGEIVYTGTESTQNGELPPRKDDSVEPSGTKKEDLNDKEKKDEEETPAPIYRAKSILDSWVWGKQPDVNELKECLSVLVKEQQALAVQSATTTLSALRLKQRLVILERYFIALNRTVFQENVKVKWKSSGISLPPVDKKSSRPAGKGVEGLARVGSRAALSFAFAFLRRAWRSGEDADLCSELLQESLDALRALPEASLFDESTVSSVWLEVVERATRFLRSVVTGDVHGTPATKGPGSIPLQDQHLALAILLELAVQRGTLSQMLSAILLLLQLWDSGAQETDNERSAQGTSAPLLPLLQRFQSIICRKDAPHSEGDMHLLSGPLSPNESFLRYLTLPQDNELAIDLRQTAVVVMAHLDRLATPCMPPLCSSPTSHKGSLQEVIGWGLIGWKYYANVIGPIQCEGLANLGVTQIACAEKRFLILSRNGRVYTQAYNSDTLAPQLVQGLASRNIVKIAAHSDGHHYLALAATGEVYSWGCGDGGRLGHGDTVPLEEPKVISAFSGKQAGKHVVHIACGSTYSAAITAEGELYTWGRGNYGRLGHGSSEDEAIPMLVAGLKGLKVIDVACGSGDAQTLAVTENGQVWSWGDGDYGKLGRGGSDGCKTPKLIEKLQDLDVVKVRCGSQFSIALTKDGQVYSWGKGDNQRLGHGTEEHVRYPKLLEGLQGKKVIDVAAGSTHCLALTEDSEVHSWGSNDQCQHFDTLRVTKPEPAALPGLDTKHIVGIACGPAQSFAWSSCSEWSIGLRVPFVVDICSMTFEQLDLLLRQVSEGMDGSADWPPPQEKECVAVATLNLLRLQLHAAISHQVDPEFLGLGLGSILLNSLKQTVVTLASSAGVLSTVQSAAQAVLQSGWSVLLPTAEERARALSALLPCAVSGNEVNISPGRRFMIDLLVGSLMADGGLESALHAAITAEIQDIEAKKEAQKEKEIDEQEANASTFHRSRTPLDKDLINTGICESSGKQCLPLVQLIQQLLRNIASQTVARLKDVARRISSCLDFEQHSRERSASLDWLLRFQRLLISKLYPGESIGQTSDISSPELMGVGSLLKKYTALLCTHIGDILPVAASIASTSWRHFAEVAYIVEGDFTGVLLPELVVSIVLLLSKNADLMQEAGAVPLLGGLLEHLDRFNHLAPGKERDDHEELAWPGIMESFFTGQNCRNNEEVTLIRKADLENHNKDGGFWTVIDGKVYDIKDFQTQSLTGNSILAQFAGEDPVVALEAALQFEDTRESMHAFCVGQYLEPDQEIVTIPDLGSLSSPLIDTERNLGLLLGLHASYLAMSTPLSPVEIECAKWLQSSIFSGGLQTSQIHYRYNEEKDEDHCSSPGGTPASKSRLCSHRRALGDHSQAFLQAIADNNIQDHNVKDFLCQIERYCRQCHLTTPIMFPPEHPVEEVGRLLLCCLLKHEDLGHVALSLVHAGALGIEQVKHRTLPKSVVDVCRVVYQAKCSLIKTHQEQGRSYKEVCAPVIERLRFLFNELRPAVCNDLSIMSKFKLLSSLPRWRRIAQKIIRERRKKRVPKKPESMDDEEKIGNEESDLEEACILPHSPINVDKRPIAIKSPKDKWQPLLSTVTGVHKYKWLKQNVQGLYPQSPLLSTIAEFALKEEPVDVEKMRKCLLKQLERAEVRLEGIDTILKLASKNFLLPSVQYAMFCGWQRLIPEGIDIGEPLTDCLKDVDLIPPFNRMLLEVTFGKLYAWAVQNIRNVLMDASATFKELGIQPVPLQTITNENPSGPSLGTIPQARFLLVMLSMLTLQHGANNLDLLLNSGMLALTQTALRLIGPSCDNVEEDMNASAQGASATVLEETRKETAPVQLPVSGPELAAMMKIGTRVMRGVDWKWGDQDGPPPGLGRVIGELGEDGWIRVQWDTGSTNSYRMGKEGKYDLKLAELPAAAQPSAEDSDTEDDSEAEQTERNIHPTAMMFTSTINLLQTLCLSAGVHAEIMQSEATKTLCGLLRMLVESGTTDKTSSPNRLVYREQHRSWCTLGFVRSIALTPQVCGALSSPQWITLLMKVVEGHAPFTATSLQRQILAVHLLQAVLPSWDKTERARDMKCLVEKLFDFLGSLLTTCSSDVPLLRESTLRRRRVRPQASLTATHSSTLAEEVVALLRTLHSLTQWNGLINKYINSQLRSITHSFVGRPSEGAQLEDYFPDSENPEVGGLMAVLAVIGGIDGRLRLGGQVMHDEFGEGTVTRITPKGKITVQFSDMRTCRVCPLNQLKPLPAVAFNVNNLPFTEPMLSVWAQLVNLAGSKLEKHKIKKSTKQAFAGQVDLDLLRCQQLKLYILKAGRALLSHQDKLRQILSQPAVQETGTVHTDDGAVVSPDLGDMSPEGPQPPMILLQQLLASATQPSPVKAIFDKQELEAAALAVCQCLAVESTHPSSPGFEDCSSSEATTPVAVQHIHPARVKRRKQSPVPALPIVVQLMEMGFSRRNIEFALKSLTGASGNASSLPGVEALVGWLLDHSDIQVTELSDADTVSDEYSDEEVVEDVDDAAYSMSTGAVVTESQTYKKRADFLSNDDYAVYVRENIQVGMMVRCCRAYEEVCEGDVGKVIKLDRDGLHDLNVQCDWQQKGGTYWVRYIHVELIGYPPPSSSSHIKIGDKVRVKASVTTPKYKWGSVTHQSVGVVKAFSANGKDIIVDFPQQSHWTGLLSEMELVPSIHPGVTCDGCQMFPINGSRFKCRNCDDFDFCETCFKTKKHNTRHTFGRINEPGQSAVFCGRSGKQLKRCHSSQPGMLLDSWSRMVKSLNVSSSVNQASRLIDGSEPCWQSSGSQGKHWIRLEIFPDVLVHRLKMIVDPADSSYMPSLVVVSGGNSLNNLIELKTININPSDTTVPLLNDYTEYHRYIEIAIKQCRSSGIDCKIHGLILLGRIRAEEEDLAAVPFLASDNEEEEDEKGNSGSLIRKKAAGLESAATIRTKVFVWGLNDKDQLGGLKGSKIKVPSFSETLSALNVVQVAGGSKSLFAVTVEGKVYACGEATNGRLGLGISSGTVPIPRQITALSSYVVKKVAVHSGGRHATALTVDGKVFSWGEGDDGKLGHFSRMNCDKPRLIEALKTKRIRDIACGSSHSAALTSSGELYTWGLGEYGRLGHGDNTTQLKPKMVKVLLGHRVIQVACGSRDAQTLALTDEGLVFSWGDGDFGKLGRGGSEGCNIPQNIERLNGQGVCQIECGAQFSLALTKSGVVWTWGKGDYFRLGHGSDVHVRKPQVVEGLRGKKIVHVAVGALHCLAVTDSGQVYAWGDNDHGQQGNGTTTVNRKPTLVQGLEGQKITRVACGSSHSVAWTTVDVATPSVHEPVLFQTARDPLGASYLGVPSDADSSAASNKISGASNSKPNRPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATDSQSGRLSSQPVVVESSHPYTDDTSTSGTVKIPGAEGLRVEFDRQCSTERRHDPLTVMDGVNRIVSVRSGREWSDWSSELRIPGDELKWKFISDGSVNGWGWRFTVYPIMPAAGPKELLSDRCVLSCPSMDLVTCLLDFRLNLASNRSIVPRLAASLAACAQLSALAASHRMWALQRLRKLLTTEFGQSININRLLGENDGETRALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVKVPTPCEALATLRPVQLIGGEQTLFAVTADGKLYATGYGAGGRLGIGGTESVSTPTLLESIQHVFIKKVAVNSGGKHCLALSSEGEVYSWGEAEDGKLGHGNRSPCDRPRVIESLRGIEVVDVAAGGAHSACVTAAGDLYTWGKGRYGRLGHSDSEDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMFDLEGSLDETGLGPSVGFDTLRGILISQGKEAAFRKVVQATMVRDRQHGPVVELNRIQVKRSRSKGGLAGPDGTKSVFGQMCAKMSSFGPDSLLLPHRVWKVKFVGESVDDCGGGYSESIAEICEELQNGLTPLLIVTPNGRDESGANRDCYLLSPAARAPVHSSMFRFLGVLLGIAIRTGSPLSLNLAEPVWKQLAGMSLTIADLSEVDKDFIPGLMYIRDNEATSEEFEAMSLPFTVPSASGQDIQLSSKHTHITLDNRAEYVRLAINYRLHEFDEQVAAVREGMARVVPVPLLSLFTGYELETMVCGSPDIPLHLLKSVATYKGIEPSASLIQWFWEVMESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEPAADDSSDDSDNEDVDSFASDSTQDYLTGH

SEQ ID NO: 995 - protein, 353 aa, Homo sapiens
MEKTLETVPLERKKREKEQFRKLFIGGLSFETTEESLRNYYEQWGKLTDCVVMRDPASKRSRGFGFVTFSSMAEVDAAMAARPHSIDGRVVEPKRAVAREESGKPGAHVTVKKLFVGGIKEDTEEHHLRDYFEEYGKIDTIEIITDRQSGKKRGFGFVTFDDHDPVDKIVLQKYHTINGHNAEVRKALSRQEMQEVQSSRSGRGGNFGFGDSRGGGGNFGPGPGSNFRGGSDGYGSGRGFGDGYNGYGGGPGGGNFGGSPGYGGGRGGYGGGGPGYGNQGGGYGGGYDNYGGGNYGSGNYNDFGNYNQQPSNYGPMKSGNFGGSRNMGGPYGGGNYGPGGSGGSGGYGGRSRY

SEQ ID NO: 996 - protein, 633 aa, Homo sapiens
MANQVNGNAVQLKEEEEPMDTSSVTHTEHYKTLIEAGLPQKVAERLDEIFQTGLVAYVDLDERAIDALREFNEEGALSVLQQFKESDLSHVQNKSAFLCGVMKTYRQREKQGSKVQESTKGPDEAKIKALLERTGYTLDVTTGQRKYGGPPPDSVYSGVQPGIGTEVFVGKIPRDLYEDELVPLFEKAGPIWDLRLMMDPLSGQNRGYAFITFCGKEAAQEAVKLCDSYEIRPGKHLGVCISVANNRLFVGSIPKNKTKENILEEFSKVTEGLVDVILYHQPDDKKKNRGFCFLEYEDHKSAAQARRRLMSGKVKVWGNVVTVEWADPVEEPDPEVMAKVKVLFVRNLATTVTEEILEKSFSEFGKLERVKKLKDYAFVHFEDRGAAVKAMDEMNGKEIEGEEIEIVLAKPPDKKRKERQAARQASRSTAYEDYYYHPPPRMPPPIRGRGRGGGRGGYGYPPDYYGYEDYYDDYYGYDYHDYRGGYEDPYYGYDDGYAVRGRGGGRGGRGAPPPPRGRGAPPPRGRAGYSQRGAPLGPPRGSRGGRGGPAQQQRGRGSRGSRGNRGGNVGGKRKADGYNQPDSKRRQTNNQQNWGSQPIAQQPLQQGGDYSGNYGYNNDNQEFYQDTYGQQWK

SEQ ID NO: 997 - protein, 359 aa, Homo sapiens
MAEPFLSEYQHQPQTSNCTGAAAVQEELNPERPPGAEERVPEEDSRWQSRAFPQLGGRPGPEGEGSLESQPPPLQTQACPESSCLREGEKGQNGDDSSAGGDFPPPAEVEPTPEAELLAQPCHDSEASKLGAPAAGGEEEWGQQQRQLGKKKHRRRPSKKKRHWKPYYKLTWEEKKKFDEKQSLRASRIRAEMFAKGQPVAPYNTTQFLMDDHDQEEPDLKTGLYSKRAAAKSDDTSDDDFMEEGGEEDGGSDGMGGDGSEFLQRDFSETYERYHTESLQNMSKQELIKEYLELEKCLSRMEDENNRLRLESKRLGGDDARVRELELELDRLRAENLQLLTENELHRQQERAPLSKFGD

SEQ ID NO: 998 - protein, 57 aa, Homo sapiens
MKFFVFALVLALMISMISADSHEKRHHGYRRKFHEKHHSHREFPFYGDYGSNYLYDN

SEQ ID NO: 999 - protein, 482 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPGVQMQAIPEDAIPEESGDEDEDDPDKRISICSSDKRIACEEEFSDSEEEGEGGRKNSSNFKKAKRVKTEDEKEKDPEEKKEVTEEEKTKEEKPEAKGVKEEVKLA

SEQ ID NO: 1000 - protein, 1011 aa, Homo sapiens
MHSMISSVDVKSEVPVGLEPISPLDLRTDLRMMMPVVDPVVREKQLQQELLLIQQQQQIQKQLLIAEFQKQHENLTRQHQAQLQEHIKELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTASEPNLKVRSRLKQKVAERRSSPLLRRKDGNVVTSFKKRMFEVTESSVSSSSPGSGPSSPNNGPTGSVTENETSVLPPTPHAEQMVSQQRILIHEDSMNLLSLYTSPSLPNITLGLPAVPSQLNASNSLKEKQKCETQTLRQGVPLPGQYGGSIPASSSHPHVTLEGKPPNSSHQALLQHLLLKEQMRQQKLLVAGGVPLHPQSPLATKERISPGIRGTHKLPRHRPLNRTQSAPLPQSTLAQLVIQQQHQQFLEKQKQYQQQIHMNKLLSKSIEQLKQPGSHLEEAEEELQGDQAMQEDRAPSSGNSTRSDSSACVDDTLGQVGAVKVKEEPVDSDEDAQIQEMESGEQAAFMQQPFLEPTHTRALSVRQAPLAAVGMDGLEKHRLVSRTHSSPAASVLPHPAMDRPLQPGSATGIAYDPLMLKHQCVCGNSTTHPEHAGRIQSIWSRLQETGLLNKCERIQGRKASLEEIQLVHSEHHSLLYGTNPLDGQKLDPRILLGDDSQKFFSSLPCGGLGVDSDTIWNELHSSGAARMAVGCVIELASKVASGELKNGFAVVRPPGHHAEESTAMGFCFFNSVAITAKYLRDQLNISKILIVDLDVHHGNGTQQAFYADPSILYISLHRYDEGNFFPGSGAPNEVGTGLGEGYNINIAWTGGLDPPMGDVEYLEAFRTIVKPVAKEFDPDMVLVSAGFDALEGHTPPLGGYKVTAKCFGHLTKQLMTLADGRVVLALEGGHDLTAICDASEACVNALLGNELEPLAEDILHQSPNMNAVISLQKIIEIQSMSLKFS

SEQ ID NO: 1001 - protein, 1198 aa, Homo sapiens
MAPVYEGMASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNHPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQAPSSTSATISLANPEVSILNYPSTLYQPSAASMAAVAQRSMPLQTGTAQICARPDPFQQALIVCPPGFQGLQASPSKHAGYSVRMENAVPIVTQAPGAQPLQIQPGLLAQQAWPSGTQQILLPPAWQQLTGVATHTSVQHATVIPETMAGTQQLADWRNTHAHGSHYNPIMQQPALLTGHVTLPAAQPLNVGVAHVMRQQPTSTTSSRKSKQHQSSVRNVSTCEVSSSQAISSPQRSKRVKENTPPRCAMVHSSPACSTSVTCGWGDVASSTTRERQRQTIVIPDTPSPTVSVITISSDTDEEEEQKHAPTSTVSKQRKNVISCVTVHDSPYSDSSSNTSPYSVQQRAGHNNANAFDTKGSLENHCTGNPRTIIVPPLKTQASEVLVECDSLVPVNTSHHSSSYKSKSSSNVTSTSGHSSGSSSGAITYRQQRPGPHFQQQQPLNLSQAQQHITTDRTGSHRRQQAYITPTMAQAPYSFPHNSPSHGTVHPHLAAAAAAAHLPTQPHLYTYTAPAALGSTGTVAHLVASQGSARHTVQHTAYPASIVHQVPVSMGPRVLPSPTIHPSQYPAQFAHQTYISASPASTVYTGYPLSPAKVNQYPYI

SEQ ID NO: 1002 - protein, 745 aa, Homo sapiens
MSLKPRVVDFDETWNKLLTTIKAVVMLEYVERATWNDRFSDIYALCVAYPEPLGERLYTETKIFLENHVRHLHKRVLESEEQVLVMYHRYWEEYSKGADYMDCLYRYLNTQFIKKNKLTEADLQYGYGGVDMNEPLMEIGELALDMWRKLMVEPLQAILIRMLLREIKNDRGGEDPNQKVIHGVINSFVHVEQYKKKFPLKFYQEIFESPFLTETGEYYKQEASNLLQESNCSQYMEKVLGRLKDEEIRCRKYLHPSSYTKVIHECQQRMVADHLQFLHAECHNIIRQEKKNDMANMYVLLRAVSTGLPHMIQELQNHIHDEGLRATSNLTQENMPTLFVESVLEVHGKFVQLINTVLNGDQHFMSALDKALTSVVNYREPKSVCKAPELLAKYCDNLLKKSAKGMTENEVEDRLTSFITVFKYIDDKDVFQKFYARMLAKRLIHGLSMSMDSEEAMINKLKQACGYEFTSKLHRMYTDMSVSADLNNKFNNFIKNQDTVIDLGISFQIYVLQAGAWPLTQAPSSTFAIPQELEKSVQMFELFYSQHFSGRKLTWLHYLCTGEVKMNYLGKPYVAMVTTYQMAVLLAFNNSETVSYKELQDSTQMNEKELTKTIKSLLDVKMINHDSEKEDIDAESSFSLNMNFSSKRTKFKITTSMQKDTPQEMEQTRSAVDEDRKMYLQAAIVRIMKARKVLRHNALIQEVISQSRARFNPSISMIKKCIEVLIDKQYIERSQASADEYSYVA

SEQ ID NO: 1003 - protein, 1052 aa, Homo sapiens
MSSAAEPPPPPPPESAPSKPAASIASGGSNSSNKGGPEGVAAQAVASAASAGPADAEMEEIFDDASPGKQKEIQEPDPTYEEKMQTDRANRFEYLLKQTELFAHFIQPAAQKTPTSPLKMKPGRPRIKKDEKQNLLSVGDYRHRRTEQEEDEELLTESSKATNVCTRFEDSPSYVKWGKLRDYQVRGLNWLISLYENGINGILADEMGLGKTLQTISLLGYMKHYRNIPGPHMVLVPKSTLHNWMSEFKRWVPTLRSVCLIGDKEQRAAFVRDVLLPGEWDVCVTSYEMLIKEKSVFKKFNWRYLVIDEAHRIKNEKSKLSEIVREFKTTNRLLLTGTPLQNNLHELWSLLNFLLPDVFNSADDFDSWFDTNNCLGDQKLVERLHMVLRPFLLRRIKADVEKSLPPKKEVKIYVGLSKMQREWYTRILMKDIDILNSAGKMDKMRLLNILMQLRKCCNHPYLFDGAEPGPPYTTDMHLVTNSGKMVVLDKLLPKLKEQGSRVLIFSQMTRVLDILEDYCMWRNYEYCRLDGQTPHDERQDSINAYNEPNSTKFVFMLSTRAGGLGINLATADVVILYDSDWNPQVDLQAMDRAHRIGQTKTVRVFRFITDNTVEERIVERAEMKLRLDSIVIQQGRLVDQNLNKIGKDEMLQMIRHGATHVFASKESEITDEDIDGILERGAKKTAEMNEKLSKMGESSLRNFTMDTESSVYNFEGEDYREKQKIAFTEWIEPPKRERKANYAVDAYFREALRVSEPKAPKAPRPPKQPNVQDFQFFPPRLFELLEKEILFYRKTIGYKVPRNPELPNAAQAQKEEQLKIDEAESLNDEELEEKEKLLTQGFTNWNKRDFNQFIKANEKWGRDDIENIAREVEGKTPEEVIEYSAVFWERCNELQDIEKIMAQIERGEARIQRRISIKKALDTKIGRYKAPFHQLRISYGTNKGKNYTEEEDRFLICMLHKLGFDKENVYDELRQCIRNSPQFRFDWFLKSRTAMELQRRCNTLITLIERENMELEEKEKAEKKKRGPKPSTQKRKMDGAPDGRGRKKKLKL

SEQ ID NO: 1004 - protein, 377 aa, Homo sapiens [sequence omitted]

SEQ ID NO: 1005 - protein, 505 aa, Homo sapiens
MSRSYNDELQFLEKINKNCWRIKKGFVPNMQVEGVFYVNDALEKLMFEELRNACRGGGVGGFLPAMKQIGNVAALPGIVHRSIGLPDVHSGYGFAIGNMAAFDMNDPEAVVSPGGVGFDINCGVRLLRTNLDESDVQPVKEQLAQAMFDHIPVGVGSKGVIPMNAKDLEEALEMGVDWSLREGYAWAEDKEHCEEYGRMLQADPNKVSARAKKRGLPQLGTLGAGNHYAEIQVVDEIFNEYAAKKMGIDHKGQVCVMIHSGSRGLGHQVATDALVAMEKAMKRDKIIVNDRQLACARIASPEGQDYLKGMAAAGNYAWVNRSSMTFLTRQAFAKVFNTTPDDLDLHVIYDVSHNIAKVEQHVVDGKERTLLVHRKGSTRAFPPHHPLIAVDYQLTGQPVLIGGTMGTCSYVLTGTEQGMTETFGTTCHGAGRALSRAKSRRNLDFQDVLDKLADMGIAIRVASPKLVMEEAPESYKNVTDVVNTCHDAGISKKAIKLRPIAVIKG

SEQ ID NO: 1006 - protein, 253 aa, Homo sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYTLMKAYRVA

SEQ ID NO: 1007 - protein, 535 aa, Homo sapiens
MEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 1008 - protein, 293 aa, Homo sapiens
MASNVTNKMDPHSMNSRVFIGNLNTLVVKKSDVEAIFSKYGKIAGCSVHKGFAFVQYDKEKNARAAVAGEDGRMIASQVVDINLAAEPKVNRGNAGVKRSAAEMYGSSFDLDYGFQRDYYDGMYSFPARVPPPPPIALAVVPSKRQRLSGNTSRRGKSGFNSKSGKRGSSKSGKLKGDDLQAIKQELTQIKQKVDSLLENLEKIEKEQSKQEVEVKNAKSEEEQSSSSMKKDETHVKMESEGGAEDSAEEGDPLDDDVNEDQGDDQLELIKDDEKEAEEGEDDRDSTNGQDDS

SEQ ID NO: 1009 - protein, 461 aa, Homo sapiens
MNNFGNEEFDCHFLDEGFTAKDILDQKINEVSSSDDKDAFYVADLGDILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 1010 - protein, 1272 aa, Homo sapiens
MPAERKKPASMEEKDSLPNNKEKDCSERRTVSSKERPKDDIKLTAKKEVSKAPEDKKKRLEDDKRKKEDKERKKKDEEKVKAEEESKKKEEEEKKKHQEEERKKQEEQAKRQQEEEAAAQMKEKEESIQLHQEAWERHHLRKELRSKNQNAPDSRPEENFFSRLDSSLKKNTAFVKKLKTITEQQRDSLSHDFNGLNLSKYIAEAVASIVEAKLKISDVNCAVHLCSLFHQRYADFAPSLLQVWKKHFEARKEEKTPNITKLRTDLRFIAELTIVGIFTDKEGLSLIYEQLKNIINADRESHTHVSVVISFCRHCGDDIAGLVPRKVKSAAEKFNLSFPPSEIISPEKQQPFQNLLKEYFTSLTKHLKRDHRELQNTERQNRRILHSKGELSEDRHKQYEEFAMSYQKLLANSQSLADLLDENMPDLPQDKPTPEEHGPGIDIFTPGKPGEYDLEGGIWEDEDARNFYENLIDLKAFVPAILFKDNEKSCQNKESNKDDTKEAKESKENKEVSSPDDLELELENLEINDDTLELEGGDEAEDLTKKLLDEQEQEDEEASTGSHLKLIVDAFLQQLPNCVNRDLIDKAAMDFCMNMNTKANRKKLVRALFIVPRQRLDLLPFYARLVATLHPCMSDVAEDLCSMLRGDFRFHVRKKDQINIETKNKTVRFIGELTKFKMFTKNDTLHCLKMLLSDFSHHHIEMACTLLETCGRFLFRSPESHLRTSVLLEQMMRKKQAMHLDARYVTMVENAYYYCNPPPAEKTVKKKRPPLQEYVRKLLYKDLSKVTTEKVLRQMRKLPWQDQEVKDYVICCMINIWNVKYNSIHCVANLLAGLVLYQEDVGIHVVDGVLEDIRLGMEVNQPKFNQRRISSAKFLGELYNYRMVESAVIFRTLYSFTSFGVNPDGSPSSLDPPEHLFRIRLVCTILDTCGQYFDRGSSKRKLDCFLVYFQRYVWWKKSLEVWTKDHPFPIDIDYMISDTLELLRPKIKLCNSLEESIRQVQDLEREFLIKLGLVNDKDSKDSMTEGENLEEDEEEEEGGAETEEQSGNESEVNEPEEEEGSDNDDDEGEEEEEENTDYLTDSNKENETDEENTEVMIKGGGLKHVPCVEDEDFIQALDKMMLENLQQRSGESVKVHQLDVAIPLHLKSQLRKGPPLGGGEGEAESADTMPFVMLTRKGNKQQFKILNVPMSSQLAANHWNQQQAEQEERMRMKKLTLDINERQEQEDYQEMLQSLAQRPAPANTNRERRPRYQHPKGAPNADLIFKTGGRRR

SEQ ID NO: 1011 - protein, 475 aa, Homo sapiens
MAAPRPPPARLSGVMVPAPIQDLEALRALTALFKEQRNRETAPRTIFQRVLDILKKSSHAVELACRDPSQVENLASSLQLITECFRCLRNACIECSVNQNSIRNLDTIGVAVDLILLFRELRVEQESLLTAFRCGLQFLGNIASRNEDSQSIVWVHAFPELFLSCLNHPDKKIVAYSSMILFTSLNHERMKELEENLNIAIDVIDAYQKHPESEWPFLIITDLFLKSPELVQAMFPKLNNQERVTLLDLMIAKITSDEPLTKDDIPVFLRHAELIASTFVDQCKTVLKLASEEPPDDEEALATIRLLDVLCEMTVNTELLGYLQVFPGLLERVIDLLRVIHVAGKETTNIFSNCGCVRAEGDISNVANGFKSHLIRLIGNLCYKNKDNQDKVNELDGIPLILDNCNISDSNPFLTQWVIYAIRNLTEDNSQNQDLIAKMEEQGLADASLLKKVGFEVEKKGEKLILKSTRDTPKP

SEQ ID NO: 1012 - protein, 454 aa, Homo sapiens
GRRRPGRGGGGSSDGRRSCPCSHWVKEAETTDMTESSMKKLASTLLDAITDKDPLVQEQVCSALCSLGEVRPVETLRACEEYLRQHDKLAHPYRAAVLRAMERVLSSRASELDKDTASTIILLASSEMTKTKDLVWDWQQAASGVLVAVGRQFISKVMEELLRRLHPGTLPHCAVLHTLASLSVANAFGVVPFLPSVLSSLLPVLGVAKQDTVRVAFCSALQRFSEGALEYLANLDRAPDPTVRKDAFATDIFSAYDVLFHQWLQSREAKLRLAVVEALGPMSHLLPSERLEEQLPKLLPGILALYKKHAETFYLSKSLGQILEAAVSVGSRTLETQLDALLAALHSQICVPVESSSPLVMSNQKEVLRCFTVLACSSPDRLLAFLLPRLDTSNERTRVGTLQVVRHVINSAGSTNTRITLMLPSAVTRLKHEDCPARAAPQPADLTAAPASVA

SEQ ID NO: 1013 - protein, 500 aa, Homo sapiens
MRNWLVLLCPCVLGAALHLWLRLRSPPPACASGAGPADQLALFPQWKSTHYDVVVGVLSARNNHELRNVIRSTWMRHLLQHPTLSQRVLVKFIIGAHGCEVPVEDREDPYSCKLLNITNPVLNQEIEAFSLSEDTSSGLPEDRVVSVSFRVLYPIVITSLGVFYDANDVGFQRNITVKLYQAEQEEALFIARFSPPSCGVQVNKLWYKPVEQFILPESFEGTIVWESQDLHGLVSRNLHKVTVNDGGGVLRVITAGEGALPHEFLEGVEGVAGGFIYTIQEGDALLHNLHSRPQRLIDHIRNLHEEDALLKEESSIYDDIVFVDVVDTYRNVPAKLLNFYRWTVETTSFNLLLKTDDDCYIDLEAVFNRIVQKNLDGPNFWWGNFRLNWAVDRTGKWQELEYPSPAYPAFACGSGYVISKDIVKWLASNSGRLKTYQGEDVSMGIWMAAIGPKRYQDSLWLCEKTCETGMLSSPQYSPWELTELWKLKERCGDPCRCQAR

SEQ ID NO: 1014 - protein, 1173 aa, Homo sapiens [sequence omitted]

SEQ ID NO: 1015 - protein, 2202 aa, Homo sapiens
MALPRLTGALRSFSNVTKQDNYNEEVADLKIKRSKLHEQVLDLGLTWKKIIKFLNEKLEKSKMQSINEDLKDILHAAKQIVGTDNGREAIESGAAFLFMTFHLKDSVGHKETKAIKQMFGPFPSSSATAACNATNRIISHFSQDDFTALVQMTEKEHGDRVFFGKNLAFSFDMHDLDHFDELPINGETQKTISLDYKKFLNEHLQEACTPELKPVEKTNGSFLWCEVEKYLNSTLKEMTEVPRVEDLCCTLYDMLASIKSGDELQDELFELLGPEGLELIEKLLQNRITIVDRFLNSSNDHRFQALQDNCKKILGENAKPNYGCQVTIQSEQEKQLMKQYRREEKRIARREKKAGEDLEVSEGLMCFDPKELRIQREQALLNARSVPILSRQRDADVEKIHYPHVYDSQAEAMKTSAFIAGAKMILPEGIQRENNKLYEEVRISYSEPMPLSFEEKPVYIQDLDEIGQLAFKGMKRLNRIQSIVFETAYNTNENMLICAPTGAGKTNIAMLTVLHEIRQHFQQGVIKKNEFKIVYVAPMKALAAEMTDYFSRRLEPLGIIVKELTGDMQLSKSEILRTQMLVTTPEKWDVVTRKSVGDVALSQIVRLLILDEVHLLHEDRGPVLESIVARTLRQVESTQSMIRILGLSATLPNYLDVATFLHVNPYIGLFFFDGRFRPVPLGQTFLGIKCANKMQQLNNMDEVCYENVLKQVKAGHQVMVFVHARNATVRTAMSLIERAKNCGHIPFFFSTQGHDYVLAEKQVQRSRNKQVRELFPDGFSIHHAGMLRQDRNLVENLFSNGHIKVLVCTATLAWGVNLPAHAVIIKGTQIYAAKRGSFVDLGILDVMQIFGRAGRPQFDKFGEGIIITTHDKLSHYLTLLTQRNPIESQFLESLADNLNAEIALGTVTNVEEAVKWISYTYLYVRMRANPLAYGISHKAYQIDPTLRKHREQLVIEVGRKLDKAQMIRFEERTGYFSSTDLGRTASHYYIKYNTIETFNELFDAHKTEGDIFAIVSKAEEFDQIKVREEEIEELDTLLSNFCELSTPGGVENSYGKINILLQTYISRGEMDSFSLISDSAYVAQNAARIVRALFEIALRKRWPTMTYRLLNLSKVIDKRLWGWASPLRQFSILPPHILTRLEEKKLTVDKLKDMRKDEIGHILHHVNIGLKVKQCVHQIPSVMMEASIQPITRTVLRVTLSIYADFTWNDQVHGTVGEPWWIWVEDPTNDHIYHSEYFLALKKQVISKEAQLLVFTIPIFEPLPSQYYIRAVSDRWLGAEAVCIINFQHLILPERHPPHTELLDLQPLPITALGCKAYEALYNFSHFNPVQTQIFHTLYHTDCNVLLGAPTGSGKTVAAELAIFRVFNKYPTSKAVYIAPLKALVRERMDDWKVRIEEKLGKKVIELTGDVTPDMKSIAKADLIVTTPEKWDGVSRSWQNRNYVQQVTILIIDEIHLLGEERGPVLEVIVSRTNFISSHTEKPVRIVGLSTALANARDLADWLNIKQMGLFNFRPSVRPVPLEVHIQGFPGQHYCPRMASMNKPAFQAIRSHSPAKPVLIFVSSRRQTRLTALELIAFLATEEDPKQWLNMDEREMENIIATVRDSNLKLTLAFGIGMHHAGLHERDRKTVEELFVNCKVQVLIATSTLAWGVNFPAHLVIIKGTEYYDGKTRRYVDFPITDVLQMMGRAGRPQFDDQGKAVILVHDIKKDFYKKFLYEPFPVESSLLGVLSDHLNAEIAGGTITSKQDALDYITWTYFFRRLIMNPSYYNLGDVSHDSVNKFLSHLIEKSLIELELSYCIEIGEDNRSIEPLTYGRIASYYYLKHQTVKMFKDRLKPECSTEELLSILSDAEEYTDLPVRHNEDHMNSELAKCLPIESNPHSFDSPHTKAHLLLQAHLSRAMLPCPDYDTDTKTVLDQALRVCQAMLDVAANQGWLVTVLNITNLIQMVIQGRWLKDSSLLTLPNIENHHLHLFKKWKPIMKGPHARGRTSIECLPELIHACGGKDHVFSSMVESELHAAKTKQAWNFLSHLPVINVGISVKGSWDDLVEGHNELSVSTLTADKRDDNKWIKLHADQEYVLQVSLQRVHFGFHKGKPESCAVTPRFPKSKDEGWFLILGEVDKRELIALKRVGYIRNHHVASLSFYTPEIPGRYIYTLYFMSDCYLGLDQQYDIYLNVTQASLSAQVNTKVSDSLTDLALK

SEQ ID NO: 1016 - protein, 202 aa, Homo sapiens
MEAEAGGLEELTDEEMAALGKEELVRRLRREEAARLAALVQRGRLMQEVNRQLQGHLGEIRELKQLNRRLQAENRELRDLCCFLDSERQRGRRAARQWQLFGTQASRAVREDLGGCWQKLAELEGRQEELLRENLALKELCLALGEEWGPRGGPSGAGGSGAGPAPELALPPCGPRDLGDGSSSTGSVGSPDQLPLACSPDD

SEQ ID NO: 1017 - protein, 301 aa, Homo sapiens
MHPEPAPPPSRSSPELPPSGGSTTSGSRRSRRRSGDGEPPGAPPPPPSAVTYPDWIGQSYSEVMSLNEHSMQALSWRKLYLSRAKLKASSRTSALLSGFAMVAMVEVQLDADHDYPPGLLIAFSACTTVLVAVHLFALMISTCILPNIEAVSNVHNLNSVKESPHERMHRHIELAWAFSTVIGTLLFLAEVVLLCWVKFLPLKKQPGQPRPTSKPPASGAAANVSTSGITPGQAAAIASTTIMVPFGLIFIVFAVHFYRSLVSHKTDRQFQELNELAEFARLQDQLDHRGDHPLTPGSHYA

SEQ ID NO: 1018 - protein, 313 aa, Homo sapiens
MSQSRHRAEAPPLEREDSGTFSLGKMITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 1019 - protein, 204 aa, Homo sapiens
MDPLSPPLCTLPPGPEPPRFVCYCEGEESGEGDRGGFNLYVTDAAELWSTCFTPDSLAALKARFGLSAAEDITPRFRAACEQQAVALTLQEDRASLTLSGGPSALAFDLSKVPGPEAAPRLRALTLGLAKRVWSLERRLAAAEETAVSPRKSPRPAGPQLFLPDPDPQRGGPGPGVRRRCPGESLINPGFKSKKPAGGVDFDET

SEQ ID NO: 1020 - protein, 1141 aa, Homo sapiens
MAAAVGVRGRYELPPCSGPGWLLSLSALLSVAARGAFATTHWVVTEDGKIQQQVDSPMNLKHPHDLVILMRQEATVNYLKELEKQLVAQKIHIEENEDRDTGLEQRHNKEDPDCIKAKVPLGDLDLYDGTYITLESKDISPEDYIDTESPVPPDPEQPDCTKILELPYSIHAFQHLRGVQERVNLSAPLLPKEDPIFTYLSKRLGRSIDDIGHLIHEGLQKNTSSWVLYNMASFYWRIKNEPYQVVECAMRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRQQEILEKHKLIQEEQILRNIIHETQMAKEAQLGNHQICRLVNQQHSLHCQWDQPVRYHRGDIFENVDYVQFGEDSSTSSMMSVNFDVQSNQSDINDSVKSSPVAHSILWIWGRDSDAYRDKQHILWPKRADCTESYPRVPVGGELPTYFLPPENKGLRIHELSSDDYSTEEEAQTPDCSITDFRKSHTLSYLVKELEVRMDLKAKMPDDHARKILLSRINNYTIPEEEIGSFLFHAINKPNAPIWLILNEAGLYWRAVGNSTFAIACLQRALNLAPLQYQDVPLVNLANLLIHYGLHLDATKLLLQALAINSSEPLTFLSLGNAYLALKNISGALEAFRQALKLTTKCPECENSLKLIRCMQFYPFLYNITSSVCSGTVVEESNGSDEMENSDETKMSEEILALVDEFQQAWPLEGFGGALEMKGRRLDLQGIRVLKKGPQDGVARSSCYGDCRSEDDEATEWITFQVKRVKKPKGDHKKTPGKKVETGQIENGHRYQANLEITGPKVASPGPQGKKRDYQRLGWPSPDECLKLRWVELTAIVSTWLAVSSKNIDITEHIDFATPIQQPAMEPLCNGNLPTSMHTLDHLHGVSNRASLHYTGESQLTEVLQNLGKDQYPQQSLEQIGTRIAKVLEKNQTSWVLSSMAALYWRVKGQGKKAIDCLRQALHYAPHQMKDVPLISLANILHNAKLWNDAVIVATMAVEIAPHFAVNHFTLGNVYVAMEEFEKALVWYESTLKLQPEFVPAKNRIQTIQCHLMLKKGRRSP

SEQ ID NO: 1021 - protein, 222 aa, Homo sapiens
MLIPKTMGKMSPGHVRGLDSSPSHHRPRGLGGKDDFMGQALGSPALCRLQTWYPAFQKLQPCLKEAKVQLGFWLQRVEVQGIGSFHGVLSLQGHRSQLLRLGNLHLDFKRCMEMPDDQAEVCCIGGPSWRTSARAVWKGNVGLEPPHRVPTVALPSGAVRRGPLSSRPLNGRSTDSLHCAPEKAADTQCQPMRAAGREAIPCKTTGADCPRLCEPASCISLT

SEQ ID NO: 1022 - protein, 74 aa, Homo sapiens
MDSEVQRDGRILDLIDDAWREDKLPYEDVAIPLNELPEPEQDNGGTTESVKEQEMKWTDLALQYLHENVPPIGN

SEQ ID NO: 1023 - protein, 550 aa, Homo sapiens
MTKVPATKKLQSSPNSGAVRPFYASENLRQVPDKPMKSIKYMDKEIINLKKDLIRSRFLIQSVKIGRGYFAILREETAKKKKQQQLQKLKEEERNKFQPAEKISEIHYGDTLLSTYDDEKLKTLGARVTRRPFTPIHSCIISPSLTEAHVEPLFRQLCALHWLLEALTIDHTHHTMKPVITCWNPKDPGGSKSTIKKINKDKSMGQKWEHFITAPKTKEFKIPTMRVTNRKPSRRGSTLSLSRASGGSSPQSSMISVNPGSDEPPSVNTQVTSSKDIEDNESSSTKPDEEPLYMNLQKLLEMVREDARRTVTIENGMQRKAPSILSVLKQNKSNSAYKEMQTTLKSSERSSSTSAESHIQPVQKKSKNRTNCDINIHYKSGVCNTMRAKFYSVAQEAGFCLQDKMEILMKRQEERGIQKFRAFVLVSNFQKDIAKMRHHISVVKGDAEEIADHWYFDLLSKLPEDLKNFRPAKKILVKLQKFGENLDLRIRPHVLLKVLQDLRIWELCSPDIAVAIEFVREHIIHMPQEDYISWLQSRINIPIGPYSALR

SEQ ID NO: 1024 - protein, 654 aa, Homo sapiens
MNGHLEAEEQQDQRPDQELTGSWGHGPRSTLVRAKAMAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 1025 - protein, 970 aa, Homo sapiens
MANETQKVGAIHFPFPFTPYSIQEDFMAELYRVLEAGKIGIFESPTGTGKSLSLICGALSWLRDFEQKKREEEARLLETGTGPLHDEKDESLCLSSSCEGAAGTPRPAGEPAWVTQFVQKKEERDLVDRLKAEQARRKQREERLQQLQHRVQLKYAAKRLRQEEEERENLLRLSREMLETGPEAERLEQLESGEEELVLAEYESDEEKKVASRVDEDEDDLEEEHITKIYYCSRTHSQLAQFVHEVKKSPFGKDVRLVSLGSRQNLCVNEDVKSLGSVQLINDRCVDMQRSRHEKKKGAEEEKPKRRRQEKQAACPFYNHEQMGLLRDEALAEVKDMEQLLALGKEARACPYYGSRLAIPAAQLVVLPYQMLLHAATRQAAGIRLQDQVVIIDEAHNLIDTITGMHSVEVSGSQLCQAHSQLLQYVERYGKRLKAKNLMYLKQILYLLEKFVAVLGGNIKQNPNTQSLSQTGTELKTINDFLFQSQIDNINLFKVQRYCEKSMISRKLFGFTERYGAVFSSREQPKLAGFQQFLQSLQPRTTEALAAPADESQASTLRPASPLMHIQGFLAALTTANQDGRVILSRQGSLSQSTLKFLLLNPAVHFAQVVKECRAVVIAGGTMQPVSDFRQQLLACAGVEAERVVEFSCGHVIPPDNILPLVICSGISNQPLEFTFQKRELPQMMDEVGRILCNLCGVVPGGVVCFFPSYEYLRQVHAHWEKGGLLGRLAARKKIFQEPKSAHQVEQVLLAYSRCIQACGQERGQVTGALLLSVVGGKMSEGINFSDNLGRCVVMVGMPFPNIRSAELQEKMAYLDQTLSPRPGTPREGSGGEPVHEGRQPVHRQGHQAPEGFCQRSAPGPAICPAPCPGQAAGLDPSPCGGQSYLWPRHCCCAEVSPGEVGLFLMGNHTTAWRRALPLSCPLETVFVVGVVCGDPVTKVKPRRRVWSPECCQDPGTGVSSRRRKWGNPE

SEQ ID NO: 1026 - protein, 1157 aa, Homo sapiens
QHVSAEVELRGPGMKGSSLSSESSPVSSPATNHSSPASTPKRVPMGPIIVPPGGHSVPSTPPVVTIAPTKTVNGVWRSESRQDAGPRSSSGGRERLIVEPPLPQEKAGGPAIPSHLLSTPYPFGLSPSSVVQDSRFPPLNLQRPVHHVVPPSTVTEDYLRSFRPYHTTDDLRMSSLPPLGLDPATAAAYYHPSYLAPHPFPHPAFRMDDSYCLSALRSPFYPIPTPGSLPPLHPSAMHLHLSGVRYPPELSHSSLAALHSERMSGLSAERLQMDEELRREREREREREREREADREREKEREREREKEREQEKEREREKERERELERQREQRAREKELLAAKALEPSFLPVAELHGLRGHATEERGKPSEQLTPTRAEKLKDASLQAPKPVQHPLHPVPTPHHTVPSLISNHGIFSLPSSSAATALLIQRTNEEEKWLARQRRLRQEKEDRQSQVSEFRQQVLEQHLDMGRPPVPAEAEHRPESTTRPGPNRHEPGGRDPPQHFGGPPPLISPKPQLHAAPTALWNPVSLMDNTLETRRAESHSLHSHPAAFEPSRQAAVPLVKVERVFCPEKAEEGPRKREPAPLDKYQPPPPPPREGGSLEHQPFLPGPGPFLAELEKSTQTILGQQRASLPQAATFGELSGPLKPGSPYRPPVPRAPDPAYIYDEFLQQRRRLVSKLDLEERRRREAQEKGYYYDLDDSYDESDEEEVRAHLRCVAEQPPLKLDTSSEKLEFLQLFGLTTQQQKEELVAQKRRKRRRMLRERSPSPPTIQSKRQTPSPRLALSTRYSPDEMNNSPNFEEKKKFLTIFNLTHISAEKRKDKERLVEMLRAMKQKALSAAVADSLTNSPRDSPAVSLSEPATQQASLDVEKPVGVAASLSDIPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGSVAVLSAEQNHKVDTSVHYNIPELQSSSRAPPPQHNGQQEPPTARKGPPTQELDRDSEEEEEEDDEDGEDEEEVPKRKWQGIEAVFEAYQEHIEEQNLERQVLQTQCRRLEARHYSLSLTAEQLSHSVAELRSQKQKMVSERERLQAELDHLRKCLALPAMHWPRGYLKGYPR

SEQ ID NO: 1027 - protein, 1328 aa, Homo sapiens
MSYAPFRDVRGPSMHRTQYVHSPYDRPGWNPRFCIISGNQLLMLDEDEIHPLLIRDRRSESSRNKLLRRTVSVPVEGRPHGEHEYHLGRSRRKSVPGGKQYSMEGAPAAPFRPSQGFLSRRLKSSIKRTKSQPKLDRTSSFRQILPRFRSADHDRARLMQSFKESHSHESLLSPSSAAEALELNLDEDSIIKPVHSSILGQEFCFEVTTSSGTKCFACRSAAERDKWIENLQRAVKPNKDNSRRVDNVLKLWIIEARELPPKKRYYCELCLDDMLYARTTSKPRSASGDTVFWGEHFEFNNLPAVRALRLHLYRDSDKKRKKDKAGYVGLVTVPVATLAGRHFTEQWYPVTLPTGSGGSGGMGSGGGGGSGGGSGGKGKGGCPAVRLKARYQTMSILPMELYKEFAEYVTNHYRMLCAVLEPALNVKGKEEVASALVHILQSTGKAKDFLSDMAMSEVDRFMEREHLIFRENTLATKAIEEYMRLIGQKYLKDAIGEFIRALYESEENCEVDPIKCTASSLAEHQANLRMCCELALCKVVNSHCVFPRELKEVFASWRLRCAERGREDIADRLISASLFLRFLCPAIMSPSLFGLMQEYPDEQTSRTLTLIAKVIQNLANFSKFTSKEDFLGFMNEFLELEWGSMQQFLYEISNLDTLTNSSSFEGYIDLGRELSTLHALLWEVLPQLSKEALLKLGPLPRLLNDISTALRNPNIQRQPSRQSERPRPQPVVLRGPSAEMQGYMMRDLNSSIDLQSFMARGLNSSMDMARLPSPTKEKPPPPPPGGGKDLFYVSRPPLARSSPAYCTSSSDITEPEQKMLSVNKSVSMLDLQGDGPGGRLNSSSVSNLAAVGDLLHSSQASLTAALGLRPAPAGRLSQGSGSSITAAGMRLSQMGVTTDGVPAQQLRIPLSFQNPLFHMAADGPGPPGGHGGGGGHGPPSSHHHHHHHHHHRGGEPPGDTFAPFHGYSKSEDLSSGVPKPPAASILHSHSYSDEFGPSGTDFTRRQLSLQDNLQHMLSPPQITIGPQRPAPSGPGGGSGGGSGGGGGGQPPPLQRGKSQQLTVSAAQKPRPSSGNLLQSPEPSYGPARPRQQSLSKEGSIGGSGGSGGGGGGGLKPSITKQHSQTPSTLNPTMPASERTVAWVSNMPHLSADIESAHIEREEYKLKEYSKSMDESRLDRVKEYEEEIHSLKERLHMSNRKLEEYERRLLSQEEQTSKILMQYQARLEQSEKRLRQQQAEKDSQIKSIIGRLMLVEEELRRDHPAMAEPLPEPKKRLLDAQERQLPPLGPTNPRVTLAPPWNGLAPPAPPPPPRLQITENGEFRNTADH

SEQ ID NO: 1028 - protein, 461 aa, Homo sapiens
MVNDRWKTMGGAAQLEDRPRDKPQRPSCGYVLCTVLLALAVLLAVAVTGAVLFLNHAHAPGTAPPPVVSTGAASANSAVVTVERADSSHLSILIDPRCPDLTDSFARLESAQASVLQALTEHQAQPRLVGDQEQELLDTLADQLPRLLARASELQTECMGLRKGHGTLGQGLSALQSEQGRLIQLLSESQGHMAHLVNSVSDILDALQRDRGLGRPRNKADLQRAPARGTRPRGCATGSRPRDCLDVLLSGQQDDGVYSVFPTHYPAGFQVYCDMRTDGGGWTVFQRREDGSVNFFRGWDAYRDGFGRLTGEHWLGLKRIHALTTQAAYELHVDLEDFENGTAYARYGSFGVGLFSVDPEEDGYPLTVADYSGTAGDSLLKHSGMRFTTKDRDSDHSENNCAAFYRGAWWYRNCHTSNLNGQYLRGAHASYADGVEWSSWTGWQYSLKFSEMKIRPVREDR

SEQ ID NO: 1029 - protein, 794 aa, Homo sapiens [sequence omitted]

SEQ ID NO: 1030 - protein, 485 aa, Homo sapiens
MASSSTVPLGFHYETKYVVLSYLGLLSQEKLQEQHLSSPQGVQLDIASQSLDQEILLKVKTEIEEELKSLDKEISEAFTSTGFDRHTSPVFSPANPESSMEDCLAHLGEKVSQELKEPLHKALQMLLSQPVTYQAFRECTLETTVHASGWNKILVPLVLLRQMLLELTRRGQEPLSALLQFGVTYLEDYSAEYIIQQGGWGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 1031 - protein, 770 aa, Homo sapiens
MLQQVNGHNPGSDGQAREYLREDLQEFLGGEVLLYKLDDLTRVNPVTLETVLRCLQARYMADTFYTNAGCTLVALNPFKPVPQLYSPELMREYHAAPQPQKLKPHVFTVGEQTYRNVKSLIEPVNQSIVVSGESGAGKTWTSRCLMKFYAVVATSPASWESHKIAERIEQRILNSNPVMEAFGNACTLRNNNSSRFGKFIQLQLNRAQQMTGAAVQTYLLEKTRVACQASSERNFHIFYQICKGASEDERLQWHLPEGAAFSWLPNPERSLEEDCFEVTREAMLHLGIDTPTQNNIFKVLAGLLHLGNIQFAASEDEAQPCQPMDDAKYSVRTAASLLGLPEDVLLEMVQIRTIRAGRQQQVFRKPCARAECDTRRDCLAKLIYARLFDWLVSVINSSICADTDSWTTFIGLLDVYGFESFPDNSLEQLCINYANEKLQLEACGLVETIHISAAGFPIRVSHRNFVERYKLLRRLHPCTSSGPDSPYPAKGLPEWCPHSEEATLEPLIQDILHTLPVLTQAAAITGDSAEAMPAPMHCGRTKVFMTDSMLELLECGRARVLEQCARCIQGGWRRHRHREQERQWRAVMLIQAAIRSWLTRKHIQRLHAAATVIKRAWQKWRIRMACLAAKELDGVEEKHFSQAPCSLSTSPLQTRLLEAIIRLWPLGLVLANTAMGVGSFQRKLVVWACLQLPRGSPSSYTVQTAQDQAGVTSIRALPQGSIKFHCRKSPLRYADICPEPSPYSITGFNQILLERHRLIHVTSSAFTGLG

SEQ ID NO: 1032 - protein, 407 aa, Homo sapiens
MAAPCAEDPSLERHFKGHRDAVTCVDFSINTKQLASGSMDSCLMVWHMKPQSRAYRFTGHKDAVTCVNFSPSGHLLASGSRDKTVRIWVPNVKGESTVFRAHTATVRSVHFCSDGQSFVTASDDKTVKVWATHRQKFLFSLSQHINWVRCAKFSPDGRLIVSASDDKTVKLWDKSSRECVHSYCEHGGFVTYVDFHPSGTCIAAAGMDNTVKVWDVRTHRLLQHYQLHSAAVNGLSFHPSGNYLITASSDSTLKILDLMEGRLLYTLHGHQGPATTVAFSRTGEYFASGGSDEQVMVWKSNFDIVDHGEVTKVPRPPATLASSMGNLPEVDFPVPPGRGRSVESVQSQPQEPVSVPQTLTSTLEHIVGQLDVLTQTVSILEQRLTLTEDKLKQCLENQQLIMQRATP

SEQ ID NO: 1033 - protein, 1401 aa, Homo sapiens
MEEIPVKVAVRIRPLLCKEALHNHQVCVRVIPNSQQVIIGRDRVFTFDFVFGKNSTQDEVYNTCIKPLVLSLIEGYNATVFAYGQTGSGKTYTIGGGHIASVVEGQKGIIPRAIQEIFQSISEHPSIDFNVKVSYIEVYKEDLRDLLELETSMKDLHIREDEKGNTVIVGAKECHVESAGEVMSLLEMGNAARHTGTTQMNEHSSRSHAIFTISICQVHKNMEAAEDGSWYSPRHIVSKFHFVDLAGSERVTKTGNTGERFKESIQINSGLLALGNVISALGDPRRKSSHIPYRDAKITRLLKDSLGGSAKTVMITCVSPSSSNFDESLNSLKYANRARNIRNKPTVNFSPESDRIDEMEFEIKLLREALQSQQAGVSQTTQINREGSPDTNRIHSLEEQVAQLQGECLGYQCCVEEAFTFLVDLKDTVRLNEKQQHKLQEWFNMIQEVRKAVLTSFRGIGGTASLEEGPQHVTVLQLKRELKKCQCVLAADEVVFNQKELEVKELKNQVQMMVQENKGHAVSLKEAQKVNRLQNEKIIEQQLLVDQLSEELTKLNLSVTSSAKENCGDGPDARIPERRPYTVPFDTHLGHYIYIPSRQDSRKVHTSPPMYSLDRIFAGFRTRSQMLLGHIEEQDKVLHCQFSDNSDDEESEGQEKSGTRCRSRSWIQKPDSVCSLVELSDTQDETQKSDLENEDLKIDCLQESQELNLQKLKNSERILTEAKQKMRELTINIKMKEDLIKELIKTGNDAKSVSKQYSLKVTKLEHDAEQAKVELIETQKQLQELENKDLSDVAMKVKLQKEFRKKMDAAKLRVQVLQKKQQDSKKLASLSIQNEKRANELEQSVDHMKYQKIQLQRKLREENEKRKQLDAVIKRDQQKIKEIQLKTGQEEGLKPKAEDLDACNLKRRKGSFGSIDHLQKLDEQKKWLDEEVEKVLNQRQELEELEADLKKREAIVSKKEALLQEKSHLENKKLRSSQALNTDSLKISTRLNLLEQELSEKNVQLQTSTAEEKTKISEQVEVLQKEKDQLQKRRHNVDEKLKNGRVLSPEEEHVLFQLEEGIEALEAAIEYRNESIQNRQKSLRASFHNLSRGEANVLEKLACLSPVEIRTILFRYFNKVVNLREAERKQQLYNEEMKMKVLERDNMVRELESALDHLKLQCDRRLTLQQKEHEQKMQLLLHHFKEQDGEGIMETFKTYEDKIQQLEKDLYFYKKTSRDHKKKLKELVGEAIRRQLAPSEYQEAGDGVLKPEGGGMLSEELKWASRPESMKLSGREREMDSSASSLRTQPNPQKLWEDIPELPPIHSSLAPPSGHMLGNENKTETDDNQFTKSHSRLSSQIQVVGNVGRLHGVTPVKLCRKELRQISALELSLRRSSLGVGIGSMAADSIEVSRKPRDLKT

SEQ ID NO: 1034 - protein, 1132 aa, Homo sapiens [sequence omitted]

SEQ ID NO: 1035 - protein, 1320 aa, Homo sapiens
MQDDSIEASTSISQLLRESYLAETRHRGNNERSRAEPSSNPCHFGSPSGAAEGGGGQDDLPDLSAFLSQEELDESVNLARLAINYDPLEKADETQARKRLSPDQMKHSPNLSFEPNFCQDNPRSPTSSKESPQEAKRPQYCSETQSKKVFLNKAADFIEELSSLFKSHSSKRIRPRACKNHKSKLESQNKVMQENSSSFSDLSERRERSSVPIPIPADTRDNEVNHALEQQEAKRREAEQAASEAAGGDTTPGSSPSSLYYEEPLGQPPRFTQKLRSREVPEGTRVQLDCIVVGIPPPQVRWYCEGKELENSPDIHIVQAGNLHSLTIAEAFEEDTGRYSCFASNIYGTDSTSAEIYIEGVSSSDSEGDPNKEEMNRIQKPNEVSSPPTTSAVIPPAVPQAQHLVAQPRVATIQQCQSPTNYLQGLDGKPIIAAPVFTKMLQNLSASEGQLVVFECRVKGAPSPKVEWYREGTLIEDSPDFRILQKKPRSMAEPEEICTLVIAEVFAEDSGCFTCTASNKYGTVSSIAQLHVRGNEDLSNNGSLHSANSTTNLAAIEPQPSPPHSEPPSVEQPPKPKLEGVLVNHNEPRSSSRIGLRVHFNLPEDDKGSEASSEAGVVTTRQTRPDSFQERFNGQATKTPEPSSPVKEPPPVLAKPKLDSTQLQQLHNQVLLEQHQLQNPPPSSPKEFPFNMTVLNSNAPPAVTTSNKQVKAPSSQTFSLARPKYFFPSTNTTAATVAPSSSPVFTLSSTPQTIQRTVSKESLLVSHPSVQTKSPGGLSIQNEPLPPGPTEPTPPPFTFSIPRGNQFQPRCVSPIPVSPTSRIQNPVAFLSSVLPSLPAIPPTNAMGLPRSAPSMPSQGLAKKNTKSPQPVNDDNIRETKNAVIRDLGKKITFSDVRPNQQEYKISSFEQRLMNEIEFRLERTPVDESDDEIQHDEIPTGKCIAPIFDKRLKHFRVTEGSPVTFTCKIVGIPVPKVYWFKDGKQISKRNEHCKMRREGDGTCSLHIESTTSDDDGNYTIMAANPQGRISCSGHLMVQSLPIRSRLTSAGQSHRGRSRVQERDKEPLQERFFRPHFLQAPGDMVAHEGRLCRLDCKVSGLPPPELTWLLNGQPVLPDASHKMLVRETGVHSLLIDPLTQRDAGTYKCIATNKTGQNSFSLELSVVAKEVKKAPVILEKLQNCGVPEGHPVRLECRVIGMPPPVFYWKKDNETIPCTRERISMHQDTTGYACLLIQPAKKSDAGWYTLSAKNEAGIVSCTARLDIYAQWHHQIPPPMSVRPSGSRYGSLTSKGLDIFSAFSSMESTMVYSCSSRSVVESDEL

SEQ ID NO: 1036 - protein, 816 aa, Homo sapiens
MKMADRSGKIIPGQVYIEVEYDYEYEAKDRKIVIKQGERYILVKKTNDDWWQVKPDENSKAFYVPAQYVKEVTRKALMPPVKQVAGLPNNSTKIMQSLHLQRSTENVNKLPELSSFGKPSSSVQGTGLIRDANQNFGPSYNQGQTVNLSLDLTHNNGKFNNDSHSPKVSSQNRTRSFGHFPGPEFLDVEKTSFSQEQSCDSAGEGSERIHQDSESGDELSSSSTEQIRATTPPNQGRPDSPVYANLQELKISQSALPPLPGSPAIQINGEWETHKDSSGRCYYYNRGTQERTWKPPRWTRDASISKGDFQNPGDQELLSSEENYYSTSYSQSDSQCGSPPRGWSEELDERGHTLYTSDYTNEKWLKHVDDQGRQYYYSADGSRSEWELPKYNASSQQQREIIKSRSLDRRLQEPIVLTKWRHSTIVLDTNDKDQEKYGLLNVTKIAENGKKVRKNWLSSWAVLQGSSLLFTKTQGSSTSWFGSNQSKPEFTVDLKGATIEMASKDKSSKKNVFELKTRQGTELLIQSDNDTVINDWFKVLSSTINNQAVETDEGIEEEIPDSPGIEKHDKEKEQKDPKKLRSFKVSSIDSSEQKKTKKNLKKFLTRRPTLQAVREKGYIKDQVFGSNLANLCQRENGTVPKFVKLCIEHVEEHGLDIDGIYRVSGNLAVIQKLRFAVNHDEKLDLNDSKWEDIHVITGALKMFFRELPEPLFTFNHFNDFVNAIKQEPRQRVAAVKDLIRQLPKPNQDTMQILFRHLRRVIENGEKNRMTYQSIAIVFGPTLLKPEKETGNIAVHTVYQNQIVELILLELSSIFGR

SEQ ID NO: 1037 - protein, 1202 aa, Homo sapiens
QLEKDKKQLEKENKRLRQQAEIKDTTLEENNVKIGNLEKENKTLSKEIGIYKESCVRLKELEKENKELVKRATIDIKTLVTLREDLVSEKLKTQQMNNDLEKLTHELEKIGLNKERLLHDEQSTDDSRYKLLESKLESTLKKSLEIKEEKIAALEARLEESTNYNQQLRQELKTVKKNYEALKQRQDEERMVQSSPPISGEDNKWERESQETTRELLKVKDRLIEVERNNATLQAEKQALKTQLKQLETQNNNLQTQILALQRQTVSLQEQNTTLQTQNAKLQVENSTLNSQSTSLMNQNAQLLIQQSSLENENESVIKEREDLKSLYDSLIKDHEKLELLHERQASEYESLISKHGTLKSAHKNLEVEHRDLEDRYNQLLKQKGQLEDLEKMLKVEQEKMLLENKNHETVAAEYKKLCGENDRLNHTYSQLLKETEVLQTDHKNLKSLLNNSKLEQTRLEAEFSKLKEQYQQLDITSTKLNNQCELLSQLKGNLEEENRHLLDQIQTLMLQNRTLLEQNMESKDLFHVEQRQYIDKLNELRRQKEKLEEKIMDQYKFYDPSPPRRRGNWITLKMRKLIKSKKDINRERQKSLTLTPTRSDSSEGFLQLPHQDSQDSSSVGSNSLEDGQTLGTKKSSMVALKRLPFLRNRPKDKDKMKACYRRSMSMNDLVQSMVLAGQWTGSTENLEVPDDISTGKRRKELGAMAFSTTAINFSTVNSSAGFRSKQLVNNKDTTSFEDISPQGVSDDSSTGSRVHASRPASLDSGRTSTSNSNNNASLHEVKAGAVNNQSRPQSHSSGEFSLLHDHEAWSSSGSSPIQYLKRQTRSSPVLQHKIPETLESRHHKIKTGSPGSEVVTLQQFLEESNKLTSVQIKSSSQENLLDEVMKSLSVSSDFLGKDKPVSCGLARSVSGKTPGDFYDRRTTKPEFLRPGPRKTEDTYFISSAGKPTPGTQGKIKLVKESSLSRQSKDSNPYATLPRASSVISTAEGTTRRTSIHDFLTKDSRLPISVDSPPAAADSNTTAASSEYHLHQWSSHILDIPTHTIGSCAQNDLAIDMPEPLYAQARNSRTGRSHFLNQTFATIRMPSDAFGMLAKDSIGPFTVAHSSQPFLSLNTELVSNISGLPPRPVIRITDQASASLDKPAQKENEQFSDHQNPSNSNLQFSINSNNLVTSACLYPDDTEAALLVSEDNQTVWYEYGCI

SEQ ID NO: 1038 - protein, 2540 aa, Homo sapiens
MAVETRAELVGKRFLCVAVGDEARSERWESGRGWRSWRAGVIRAVSHRDSRNPDLAVYVEFDDLEWDKREWVKVYEDFSTFLVEYHLIWAKRNDPSQTQGSKSKQIQWPALTFKPLVERNIPSSVTAVEFLVDKQLDFLTEDSAFQPYQDDIDSLNPVLRDNPQLHEEVKVWVKEQKVQEIFMQGPYSLNGYRVRVYRQDSATQWFTGIITHHDLFTRTMIVMNDQVLEPQNVDPSMVQMTFLDDVVHSLLKGENIGITSRRRSRANQNVNAVHSHYTRAQANSPRPAMNSQAAVPKQNTHQQQQQRSIRPNKRKGSDSSIPDEEKMKEEKYDYISRGENPKGKNKHLMNKRRKPEEDEKKLNMKRLRTDNVSDFSESSDSENSNKRIIDNSSEQKPENELKNKNTSKINGEEGKPHNNEKAGEETLKNSQPPWDQIQEDKKHEEAEKRKSVDTQLQEDMIIHSSEQSTVSDHNSNDLLPQECNMDKTHTMELLPKEKFVSRPPTPKCVIDITNDTNLEKVAQENSSTFGLQTLQKMDPNVSDSKHSIANAKFLETAKKDSDQSWVSDVVKVDLTQSSVTNASSGNDHLNMEKEKYVSYISPLSAVSVMEDKLHKRSPPPETIKSKLNTSVDTHKIKSSPSPEVVKPKITHSPDSVKSKATYVNSQATGERRLANKIEHELSRCSFHPIPTRSSTLETTKSPLIIDKNEHFTVYRDPALIGSETGANHISPFLSQHPFPLHSSSHRTCLNPGTHHPALTPAPHLLAGSSSQTPLPTINTHPLTSGPHHAVHHPHLLPTVLPGVPTASLLGGHPRLESAHASSLSHLALAHQQQQQLLQHQSPHLLGQAHPSASYNQLGLYPIIWQYPNGTHAYSGLGLPSSKWVHPENAVNAEASLRRNSPSPWLHQPTPVTSADGIGLLSHIPVRPSSAEPHRPLKITAHSSPPLTKTLVDHHKEELERKAFMEPLRSVASTSAKNDLDLNRSQTGKDCHLHRHFVDPVLNQLQRPPQETGERLNKYKEEHRRILQESIDVAPFTTKIKGLEGERENYSRVASSSSSPKSHIIKQDMDVERSVSDLYKMKHSVPQSLPQSNYFTTLSNSVVNEPPRSYPSKEVSNIYGDKQSNALAAAAANPQTLTSFITSLSKPPPLIKHQPESEGLVGKIPEHLPHQIASHSVTTFRNDCRSPTHLTVSSTNTLRSMPALHRAPVFHPPIHHSLERKEGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSKSVSQPVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTGIPRSVLKDWRKVKKLKQTGESFLQDDSCCEIGPNLQKCRECRLIRSKKGEEPAHSPVFCRFYYFRRLSFSKNGVVRIDGFSSPDQYDDEAMSLWTHENFEDDELDIETSKYILDIIGDKFCQLVTSEKTALSWVKKDAKIAWKRAVRGVREMCDACEATLFNIHWVCQKCGFVVCLDCYKAKERKSSRDKELYAWMKCVKGQPHDHKHLMPTQIIPGSVLTDLLDAMHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKENKELTLENQIKEEREQDNSESPNGRTSPLVSQNNEQGSTLRDLLTTTAGKLRVGSTDAGIAFAPVYSMGAPSSKSGRTMPNILDDIIASVVENKIPPSKTSKINVKPELKEEPEESIISAVDENNKLYSDIPHSWICEKHILWLKDYKNSSNWKLFKECWKQGQPAVVSGVHKKMNISLWKAESISLDFGDHQADLLNCKDSIISNANVKEFWDGFEEVSKRQKNKSGETVVLKLKDWPSGEDFKTMMPARYEDLLKSLPLPEYCNPEGKFNLASHLPGFFVRPDLGPRLCSAYGVVAAKDHDIGTTNLHIEVSDVVNILVYVGIAKGNGILSKAGILKKFEEEDLDDILRKRLKDSSEIPGALWHIYAGKDVDKIREFLQKISKEQGLEVLPEHDPIRDQSWYVNKKLRQRLLEEYGVRTCTLIQFLGDAIVLPAGALHQVQNFHSCIQVTEDFVSPEHLVESFHLTQELRLLKEEINYDDKLQVKNILYHAVKEMVRALKIHEDEVEDMEEN

SEQ ID NO: 1039 - protein, 953 aa, Homo sapiens [sequence omitted]

SEQ ID NO: 1040 - protein, 515 aa, Homo sapiens
MSTIAAFYGGKSILITGATGFLGKVLMEKLFRTSPDLKVIYILVRPKAGQTLQQRVFQILDSKLFEKVKEVCPNVHEKIRAIYADLNQNDFAISKEDMQELLSCTNIIFHCAATVRFDDTLRHAVQLNVTATRQLLLMASQMPKLEAFIHISTAYSNCNLKHIDEVTYPCPVEPKKIIDSLEWLDDAIIDEITPKLIRDWPNIYTYTKALGEMVVQQESRNLNIAIIRPSIVGATWQEPFPGWVDNINGPNGIIIATGKGFLRAIKATPMAVADVIPVDTVVNLMLAVGWYTAVHRPKSTLVYHITSGNMNPCNWHKMGVQVLATFEKIPFERPFRRPNANFTSNSFTSQYWNAVSHRAPAIIYDCYLRLTGRKPRMTKLMNRLLRTVSMLEYFINRSWEWSTYNTEMLMSELSPEDQRVFNFDVRQLNWLEYIENYVLGVKKYLLKEDMAGIPKAKQRLKRLRNIHYLFNTALFLIAWRLLIARSQMARNVWFFIVSFCYKFLSYFRASSTLKV

SEQ ID NO: 1041 - protein, 1150 aa, Homo sapiens [sequence omitted]

SEQ ID NO: 1042 - protein, 2472 aa, Homo sapiens
MTARGQSPLAPLLETLEDPSASHGGQTDAYLTLTSRMTGEEGKEVITEIEKKLPRLYKVLKTHISSQNSELSSAALQALGFCLYNPKITSELSEANALELLSKLNDTIKNSDKNVRTRALWVISKQTFPSEVVGKMVSSIIDSLEILFNKGETHSAVVDFEALNVIVRLIEQAPIQMGEEAVRWAKLVIPLVVHSAQKVHLRGATALEMGMPLLLQKQQEIASITEQLMTTKLISELQKLFMSKNETYVLKLWPLFVKLLGRTLHRSGSFINSLLQLEELGFRSGAPMIKKIAFIAWKSLIDNFALNPDILCSAKRLKLLMQPLSSIHVRTETLALTKLEVWWYLLMRLGPHLPANFEQVCVPLIQSTISIDSNASPQGNSCHVATSPGLNPMTPVHKGASSPYGAPGTPRMNLSSNLGGMATIPSIQLLGLEMLLHFLLGPEALSFAKQNKLVLSLEPLEHPLISSPSFFSKHANTLITAVHDSFVAVGKDAPDVVVSAIWKELISLVKSVTESGNKKEKPGSEVLTLLLKSLESIVKSEVFPVSKTLVLMEITIKGLPQKVLGSPAYQVANMDILNGTPALFLIQLIFNNFLECGVSDERFFLSLESLVGCVLSGPTSPLAFSDSVLNVINQNAKQLENKEHLWKMWSVIVTPLTELINQTNEVNQGDALEHNFSAIYGALTLPVNHIFSEQRFPVATMKTLLRTWSELYRAFARCAALVATAEENLCCEELSSKIMSSLEDEGFSNLLFVDRIIYIITVMVDCIDFSPYNIKYQPKVKSPQRPSDWSKKKNEPLGKLTSLFKLIVKVIYSFHTLSFKEAHSDTLFTIGNSITGIISSVLGHISLPSMIRKIFATLTRPLALFYENSKLDEVPKVYSCLNNKLEKLLGEIIACLQFSYTGTYDSELLEQLSPLLCIIFLHKNKQIRKQSAQFWNATFAKVMMLVYPEELKPVLTQAKQKFLLLLPGLETVEMMEESSGPYSDGTENSQLNVKISGMERKSNGKRDSFLAQTKNKKENMKPAAKLKLESSSLKVKGEILLEEEKSTDFVFIPPEGKDAKERILTDHQKEVLKTKRCDIPAMYNNLDVSQDTLFTQYSQEEPMEIPTLTRKPKEDSKMMITEEQMDSDIVIPQDVTEDCGMAEHLEKSSLSNNECGSLDKTSPEMSNSNNDERKKALISSRKTSTECASSTENSFVVSSSSVSNTTVAGTPPYPTSRRQTFITLEKFDGSENRPFSPSPLNNISSTVTVKNNQETMIKTDFLPKAKQREGTFSKSDSEKIVNGTKRSSRRAGKAEQTGNKRSKPLMRSEPEKNTEESVEGIVVLENNPPGLLNQTECVSDNQVHLSESTMEHDNTKLKAATVENAVLLETNTVEEKNVEINLESKENTPPVVISADQMVNEDSQVQITPNQKTLRRSSRRRSEVVESTTESQDKENSHQKKERRKEEEKPLQKSPLHIKDDVLPKQKLIAEQTLQENLIEKGSNLHEKTLGETSANAETEQNKKKADPENIKSEGDGTQDIVDKSSEKLVRGRTRYQTRRASQGLLSSIENSESDSSEAKEEGSRKKRSGKWKNKSNESVDIQDQEEKVVKQECIKAENQSHDYKATSEEDVSIKSPICEKQDESNTVICQDSTVTSDLLQVPDDLPNVCEEKNETSKYAEYSFTSLPVPESNLRTRNAIKRLHKRDSFDNCSLGESSKIGISDISSLSEKTFQTLECQHKRSRRVRRSKGCDCCGEKSQPQEKSLIGLKNTENNDVEISETKKADVQAPVSPSETSQANPYSEGQFLDEHHSVNFHLGLKEDNDTINDSLIVSETKSKENTMQESLPSGIVNFREEICDMDSSEAMSLESQESPNENFKTVGPCLGDSKNVSQESLETKEEKPEETPKMELSLENVTVEGNACKVTESNLEKAKTMELNVGNEASFHGQERTKTGISEEAAIEENKRNDDSEADTAKLNAKEVATEEFNSDISLSDNTTPVKLNAQTEISEQTAAGELDGGNDVSDLHSSEETNTKMKNNEEMMIGEAMAETGHDGETENEGITTKTSKPDEAETNMLTAEMDNFVCDTVEMSTEEGIIDANKTETNTEYSKSEEKLDNNQMVMESDILQEDHHTSQKVEEPSQCLASGTAISELIIEDNNASPQKLRELDPSLVSANDSPSGMQTRCVWSPLASPSTSILKRGLKRSQEDEISSPVNKVRRVSFADPIYQAGLADDIDRRCSIVRSHSSNSSPIGKSVKTSPTTQSKHNTTSAKGFLSPGSRSPKFKSSKKCLISEMAKESIPCPTESVYPPLVNCVAPVDIILPQITSNMWARGLGQLIRAKNIKTIGDLSTLTASEIKTLPIRSPKVSNVKKALRIYHEQQVKTRGLEEIPVFDISEKTVNGIENKSLSPDEERLVSDIIDPVALEIPLSKNLLAQISALALQLDSEDLHNYSGSQLFEMHEKLSCMANSVIKNLQSRWRSPSHENSI

SEQ ID NO: 1043 - protein, 368 aa, Homo sapiens
MAAAAEERMAEEGGGGQGDGGSSLASGSTQRQPPPPAPQHPQPGSQALPAPALAPDQLPQNNTLVALPIVAIENILSFMSYDEISQLRLVCKRMDLVCQRMLNQGFLKVERYHNLCQKQVKAQLPRRESERRNHSLARHADILAAVETRLSLLNMTFMKYVDSNLCCFIPGKVIDEIYRVLRYVNSTRAPQRAHEVLQELRDISSMAMEYFDEKIVPILKRKLPGSDVSGRLMGSPPVPGPSAALTTMQLFSKQNPSRQEVTKLQQQVKTNGAGVTVLRREISELRTKVQEQQKQLQDQDQKLLEQTQIIGEQNARLAELERKLREVMESAVGNSSGSGQNEESPRKRKKATEAIDSLRKSKRLRNRK

SEQ ID NO: 1044 - protein, 663 aa, Homo sapiens
MLQMPKLNEIPPGRAGRREARGEGRWPGQTGPEAARLEWRAQGQAGGARAPWDSWGSSRLPTQPGPGWSRCPPSLLCALSFQKSTMESKDEVSDTDSGIILQSGPDSPVSPMKELTHAVHKQQRALEARLEACLEELRRLCLREAELTGTLPAEYPLKPGEKAPKVRRRIGAAYKLDDWALHREDPLSSLERQLALQLQITEAARRLCLEENLSRQARRQRKHSMLQEEKKLQELQRCLVERRRNSEPPPAAALPLGRELSASDDSSLSDGLLLEEEESQVPKPPPESPAPPSRPLPPQTLEGLQPTGPEAGSPERAPVQNSPWKETSLDHPYEKPRKSSEPWSESSSPATTPQDGPSASSLWLLEPASYHVVPIRGVPGQWQGRTSAPATPEIQGRRGQSQSLRVDSFRAGPEGRGRSAFPRRRPTHYTVTVPDSCFPATKPPLPHAACHSCSEDSGSDVSSISHPTSPGSSSPDISFLQPLSPPKTHRHRGAWVPAGSRELVAHHPKLLLPPGYFPAGRYVVVAESPLPPGEWELCRAAPGPAYEEEGTPLRYQRLVPSRSRIVRTPSLKDSPAGRGLSKAAVSEELKWWHERARLRSTRPHSLDRQGAFRVRSLPLGREGFGRALGPRAQVPTVCVLWRSPDGAPVQVFVPEKGEIISQV

SEQ ID NO: 1045 - protein, 672 aa, Homo sapiens
MSKEERPGREEILECQVMWEPDSKKNTQMDRFRAAVGAACGLALESYDDLYHWSVESYSDFWAEFWKFSGIVFSRVYDEVVDTSKGIADVPEWFKGSRLNYAENLLRHKENDRVALYIAREGKEEIVKVTFEELRQEVALFAAAMRKMGVKKGDRVVGYLPNSEHAVEAMLAAASIGAIWSSTSPDFGVNGVLDRFSQIQPKLIFSVEAVVYNGKEHNHMEKLQQVVKGLPDLKKVVVIPYVSSRENIDLSKIPNSVFLDDFLATGTSEQAPQLEFEQLPFSHPLFIMFSSGTTGAPKCMVHSAGGTLIQHLKEHLLHGNMTSSDILLCYTTVGWMMWNWMVSLLATGAAMVLYDGSPLVPTPNVLWDLVDRIGITVLVTGAKWLSVLEEKAMKPVETHSLQMLHTILSTGSPLKAQSYEYVYRCIKSSILLGSISGGTDIISCFMGHNFSLPVYKGEIQARNLGMAVEAWNEEGKAVWGESGELVCTKPIPCQPTHFWNDENGNKYRKAYFSKFPGIWAHGDYCRINPKTGGIVMLGRSDGTLNPNGVRFGSSEIYNIVESFEEVEDSLCVPQYNKYREERVILFLKMASGHAFQPDLVKRIRDAIRMGLSARHVPSLILETKGIPYTLNGKKVEVAVKQIIAGKAVEQGGAFSNPETLDLYRDIPELQGF

SEQ ID NO: 1046 - protein, 527 aa, Homo sapiens
MESQGVPPGPYRATKLWNEVTTSFRAGMPLRKHRQHFKKYGNCFTAGEAVDWLYDLLRNNSNFGPEVTRQQTIQLLRKFLKNHVIEDIKGRWGSENVDDNNQLFRFPATSPLKTLPRRYPELRKNNIENFSKDKDSIFKLRNLSRRTPKRHGLHLSQENGEKIKHEIINEDQENAIDNRELSQEDVEEVWRYVILIYLQTILGVPSLEEVINPKQVIPQYIMYNMANTSKRGVVILQNKSDDLPHWVLSAMKCLANWPRSNDMNNPTYVGFERDVFRTIADYFLDLPEPLLTFEYYELFVNILGLLQPHLERVAIDALQLCCLLLPPPNRRKLQLLMRMISRMSQNVDMPKLHDAMGTRSLMIHTFSRCVLCCAEEVDLDELLAGRLVSFLMDHHQEILQVPSYLQTAVEKHLDYLKKGHIENPGDGLFAPLPTYSYCKQISAQEFDEQKVSTSQAAIAELLENIIKNRSLPLKEKRKKLKQFQKEYPLIYQKRFPTTESEAALFGDKPTIKQPMLILRKPKFRSLR

SEQ ID NO: 1047 - protein, 977 aa, Homo sapiens
MGAEEEVLVTLSGGAPWGFRLHGGAEQRKPLQVSKIRRRSQAGRAGLRERDQLLAINGVSCTNLSHASAMSLIDASGNQLVLTVQRLADEGPVQSPSPHELQVLSPLSPLSPEPPGAPVPQPLQPGSLRSPPDSEAYYGETDSDADGPATQEKPRRPRRRGPTRPTPPGAPPDEVYLSDSPAEPAPTIPGPPSQGDSRVSSPSWEDGAALQPPPAEALLLPHGPLRPGPHLIPMVGPVPHPVAEDLTTTYTQKAKQAKLQRAESLQEKSIKEAKTKCRTIASLLTAAPNPHSKGVLMFKKRRQRAKKYTLVSFGAAAGTGAEEEDGVPPTSESELDEEAFSDARSLTNQSDWDSPYLDMELARAGSRASEGQGSGLGGQLSEVSGRGVQLFEQQRQRADSSTQELARVEPAAMLNGEGLQSPPRAQSAPPEAAVLPPSPLPAPVASPRPFQPGGGAPTPAPSIFNRSARPFTPGLQGQRPTTTSVIFRPLAPKRANDSLGGLSPAPPPFLSSQGPTPLPSFTSGVPSHAPVSGSPSTPRSSGPVTATSSLYIPAPSRPVTPGGAPEPPAPPSAAAMTSTASIFLSAPLRPSARPEAPAPGPGAPEPPSAREQRISVPAARTGILQEARRRGTRKQMFRPGKEETKNSPNPELLSLVQNLDEKPRAGGAESGPEEDALSLGAEACNFMQPVGARSYKTLPHVTPKTPPPMAPKTPPPMTPKTPPPVAPKPPSRGLLDGLVNGAASSAGIPEPPRLQGRGGELFAKRQSRADRYVVEGTPGPGLGPRPRSPSPTPSLPPSWKYSPNIRAPPPIAYNPLLSPFFPQAARTLPKAQSQGPRATPKQGIKALDFMRHQPYQLKTAMFCFDEVPPTPGPIASGSPKTARVQEIRRFSTPAPQPTAEPLAPTVLAPRAATTLDEPIWRTELASAPVPSPAPPPEAPRGLGASPSSCGFQVARPRFSATRTGLQAHVWRPGAGHQ

SEQ ID NO: 1048 - protein, 706 aa, Homo sapiens [sequence omitted]

SEQ ID NO: 1049 - protein, 193 aa, Homo sapiens
MASHGGNTLEIVQKMGRCRLECGEGLRPCLVDGTVTAAVCLLGGASPPAAGRPLRETAESWSPGQPGGDPSAGHRGHSRQQELRTLSATLLSNLWTLSSGQSCRIRHRTYSSALGRGSLKKSPGLKTKRDTSVRDRRGDRHRGEGHVETEAETGVMRPQAQGRLEPPGAGRGGKDPPLEPLRKNQTQLQWVGW

SEQ ID NO: 1050 - protein, 851 aa, Homo sapiens
MAPDLASQRHSESFPSVNSRPNVILPGREGRREGLPPGGGTRGSLVPTRPVPPSPAPLGTSPYSWSRSGPGRGGGAGSSRVPRGVPGPAVCAPGSLLHHASPTQTMAAADGSLFDNPRTFSRRPPAQASRQAKATKRKYQASSEAPPAKRRNETSFLPAKKTSVKETQRTFKGNAQKMFSPKKHSVSTSDRNQEERQCIKTSSLFKNNPDIPELHRPVVKQVQEKVFTSAAFHELGLHPHLISTINTVLKMSSMTSVQKQSIPVLLEGRDALVRSQTGSGKTLAYCIPVVQSLQAMESKIQRSDGPYALVLVPTRELALQSFDTVQKLLKPFTWIVPGVLMGGEKRKSEKARLRKGINILISTPGRLVDHIKSTKNIHFSRLRWLVFDEADRILDLGFEKDITVILNAVNAECQKRQNVLLSATLTEGVTRLADISLHDPVSISVLDKSHDQLNPKDKAVQEVCPPPAGDKLDSFAIPESLKQHVTVVPSKLRLVCLAAFILQKCKFEEDQKMVVFFSSCELVEFHYSLFLQTLLSSSGAPASGQLPSASMRLKFLRLHGGMEQEERTAVFQEFSHSRRGVLLCTDVAARGLDLPQVTWIVQYNAPSSPAEYIHRIGRTARIGCHGSSLLILAPSEAEYVNSLASHKINVSEIKMEDILCVLTRDDCFKGKRWGAQKSHAVGPQEIRERATVLQTVFEDYVHSSERRVSWAKKALQSFIQAYATYPRELKHIFHVRSLHLGHVAKSFGLRDAPRNLSALTRKKRKAHVKRPDLHKKTQSKHSLAEILRSEYSSGMEADIAKVKKQNAPGEPGGRPLQHSLQPTPCFGRGKTLKWRKTQKGVQRDSKTSQKV

SEQ ID NO: 1051 - protein, 638 aa, Homo sapiens
MGRYSAVGSVTERIFTLYYDHLGFLHKLTLGRFEASGPPTAFGNSRNLFGQPPDMGFETALAPQHTSLDEIIFFAYVPENEPQETIYSKKFGNIHYGKVIHSGKTGRAYIRKVLQHTTPKGFLSSVIAEMKEPFGLEEVNESSCLSSSLLINKAGNVYKLTLDSQVVQALFEDTDIEKTVVLPGYSSFLITSILDNKNALAIATMPESAPNNMTFLKSTWFLYNFGQRNGRTWKIYSKPCNYWFQHDDSPSLNIVKYIDLGNSYVLKAKVIRNAKGFRMLEIPLLTVFVGNPNLLEVTAEVTFDDTDSYVITISAASKVLHQGSTSLAFIMWSASTECFVTTMVPTLKSSCSYLRSMHHIPSKFIPFEDWISGVHKDSQGFNLIKTLPINYRPPSNMGIAIPLTDNFYHADPSKPIPRNMFHMSKKTGKFKQCANVSTREECNCTKDQKFSHAVAFSDCREKVPRFKFPITQYPVSLEIINEDGRVPLQSPYLVTVTEVNMRHNWKLKHTVPENIKRMKQLVEPILGAAVYNPSGLNLSIKGSELFHFRVTVISGVTFCNLIEEFQIYVDEAPLPFPGHTLIAVATAVVLGGLIFIAFMFQLQGIHPWRTFQRWIRRNQEKFSSISLSELIHRSKSEE

SEQ ID NO: 1052 - protein, 393 aa, Homo sapiens
MDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVEQQPSHLACPDVLNLSLDSSDVERLERFFDSEDEDFEILSL

SEQ ID NO: 1053 - protein, 221 aa, Homo sapiens
MKSNLHPQRCHRGRRGKMAPSSKQEAEEEGEVAMNIPHTEDEEVMNKEAGEVDVVAMTMVAEGEEEEISIKEAGQMEGVVEEVATKMVVIEIQVSSQVAIMVATAVVAIKAEVMVASKHLLHIQEVDTRVVATSRTIDTKMAGTMVIVVVVVVGEVVVEAEVVVQAREEAGEEEGARIITKGVNLNSISSMEVISIIILDLDREDITLVEATEPYILLELK

SEQ ID NO: 1054 - protein, 488 aa, Homo sapiens
MNFTPTHTPVCRKRTVVSKRGVAVSGPTKRRGMADSLESTPLPSPEDRLAKLHPSKELLEYYQKKMAECEAENEDLLKKLELYKEACEGQHKLECDLQQREEEIAELQKALSDMQVCLFQEREHVLRLYSENDRLRIRELEDKKKIQNLLALVGTDAGEVTYFCKEPPHKVTILQKTIQAVGECEQSESSAFKADPKISKRRPSRERKESSEHYQRDIQTLILQVEALQAQLGEQTKLSREQIEGLIEDRRIHLEEIQVQHQRNQNKIKELTKNLHHTQELLYESTKDFLQLRSENQNKEKSWMLEKDNLMSKIKQYRVQCKKKEDKIGKVLPVMHESHHAQSEYIKSLKDKLVQEKKLSNMYQEQCISLEEELARIREEEGMRREIFKDRTNKMGKRLQIMTKRYEALERRRILEVEGFKTDIKVLRQKLKDLEQMLYKATVNARANQDLALLCEVRDSNRRAHKIQGELKNLKSKVFGLENELRLC

SEQ ID NO: 1055 - protein, 793 aa, Homo sapiens [sequence omitted]

SEQ ID NO: 1056 - protein, 525 aa, Homo sapiens
MSCSSRASSSRAGGSSSARVSAGGSSFSSGSRCGLGGSSAQGFRGGASSCSLSGGSSGAFGGSFGGGFGSCSVGGGFGGASGSGTGFGGGSSFGGVSGFGRGSGFCGSSRFSSGATGGFYSYGGGMGGGVGDGGLFSGGEKQTMQNLNDRLANYLDKVRALEEANTDLENKIKEWYDKYGPGSGDGGSGRDYSKYYSIIEDLRNQIIAATVENAGIILHIDNARLAADDFRLKYENELCLRQSVEADINGLRKVLDDLTMTRSDLEMQIESFTEELAYLRKNHEEEMKNMQGSSGGEVTVEMNAAPGTDLTKLLNDMRAQYEELAEQNRREAEERFNKQSASLQAQISTDAGAATSAKNEITELKRTLQALEIELQSQLAMKSSLEGTLADTEAGYVAQLSEIQTQISALEEEICQIWGETKCQNAEYKQLLDIKTRLEVEIETYRRLLDGEGGGSSFAEFGGRNSGSVNMGSRDLVSGDSRSGSCSGQGRDSSKTRVTKTIVEELVDGKVVSSQVSSISEVKVK

SEQ ID NO: 1057 - protein, 1755 aa, Homo sapiens; identical to SEQ ID NO: 792

SEQ ID NO: 1058 - protein, 691 aa, Homo sapiens
MMAENNLKMLKIQQCVVANKLPRNRPYVCNICFKHFETPSKLARHYLIHTGQKPFECDVCHKTFRQLVHLERHQLTHSLPFKCSICQRHFKNLKTFVKHQQLHNETYQNNVKQVRRLLEAKQEKSMYGVYNTFTTEERWALHPCSKSDPMYSMKRRKNIHACTICGKMFPSQSKLDRHVLIHTGQRPFKCVLCTKSFRQSTHLKIHQLTHSEERPFQCCFCQKGFKIQSKLLKHKQIHTRNKAFRALLLKKRRTESRPLPNKLNANQGGFENGEIGESEENNPLDVHSIYIVPFQCPKCEKCFESEQILNEHSCFAARSGKIPSRFKRSYNYKTIVKKILAKLKRARSKKLDNFQSEKKVFKKSFLRNCDLISGEQSSEQTQRTFVGSLGKHGTYKTIGNRKKKTLTLPFSWQNMGKNLKGILTTENILSIDNSVNKKDLSICGSSGEEFFNNCEVLQCGFSVPRENIRTRHKICPCDKCEKVFPSISKLKRHYLIHTGQRPFGCNICGKSFRQSAHLKRHEQTHNEKSPYASLCQVEFGNFNNLSNHSGNNVNYNASQQCQAPGVQKYEVSESDQMSGVKAESQDFIPGSTGQPCLPNVLLESEQSNPFCSYSEHQEKNDVFLYRCSVCAKSFRSPSKLERHYLIHAGQKPFECSVCGKTFRQAPHWKRHQLTHFKERPQGKVVALDSVM

SEQ ID NO: 1059 - protein, 418 aa, Homo sapiens
MGEEGTGGTVHLLCLAASSGVPLFCRSSRGGAPARQQLPFSVIGSLNGVHMFGQNLEVQLSSARTENTTVVWKSFHDSITLIVLSSEVGISELRLERLLQMVFGAMVLLVGLEELTNIRNVERLKKDLRASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 1060 - protein, 373 aa, Homo sapiens
MAQGRERDEGPHSAGGASLSVRWVQGFPKQNVHFVNDNTICYPCGNYVIFINIETKKKTVLQCSNGIVGVMATNIPCEVVAFSDRKLKPLIYVYSFPGLTRRTKLKGNILLDYTLLSFSYCGTYLASYSSLPEFELALWNWESSIILCKKSQPGMDVNEMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKVCWMVIS

SEQ ID NO: 1061 - protein, 360 aa, Homo sapiens
MGEKKPEPLDFVKDFQEYLTQQTHHVNMISGSVSGDKEAEALQGAGTDGDQNGLDHPSVEVSLDENSGMLVDGFERTFDGKLKCRYCNYASKGTARLIEHIRIHTGEKPHRCHLCPFASAYERHLEAHMRSHTGEKPYKCELCSFRCSDRSNLSHHRRRKHKMVPIKGTRSSLSSKKMWGVLQKKTSNLGYSRRALINLSPPSVVVQKPDYLNDFTHEIPNIQTDSYESMAKTTPTGGLPRDPQELMVDNPLNQLSTLAGQLSSLPPENQNPASPDVVPCPDEKPFMIQQPSTQAVVSAVSASIPQSSSPTSPEPRPSHSQRNYSPVAGPSSEPSAHTSTPSIGNSQPSTPAPALPVQDP

SEQ ID NO: 1062 - protein, 865 aa, Homo sapiens
MAVARVDAALPPGEGSVVNWSGQGLQKLGPNLPCEADIHTLILDKNQIIKLENLEKCKRLIQLSVANNRLVRMMGVAKLTLLRVLNLPHNSIGCVEGLKELVHLEWLNLAGNNLKAMEQINSCTALQHLDLSDNNISQIGDLSKLVSLKTLLLHGNIITSLRMAPAYLPRSLAILSLAENEIRDLNEISFLASLTELEQLSIMNNPCVMATPSIPGFDYRPYIVSWCLNLRVLDGYVISQKESLKAEWLYSQGKGRAYRPGQHIQLVQYLATVCPLTSTLGLQTAEDAKLEKILSKQRFHQRQLMNQSQNEELSPLVPVETRASLIPEHSSPVQDCQISQESEPVIQVNSWVGINSNDDQLFAVKNNFPASVHTTRYSRNDLHLEDIQTDEDKLNCSLLSSESTFMPVASGLSPLSPTVELRLQGINLGLEDDGVADESVKGLESQVLDKEEEQPLWAANENSVQMMRSEINTEVNEKAGLLPCPEPTIISAILKDDNHSLTFFPESTEQKQSDIKKPENTQPENKETISQATSEKLPMILTQRSVALGQDKVALQKLNDAATKLQACWRGFYARNYNPQAKDVRYEIRLRRMQEHIVCLTDEIRRLRKERDEERIKKFVQEEAFRFLWNQVRSLQVWQQTVDQRLSSWHTDVPPISSTLVPSKHPLFTQSQESSCDQNADWFIASDVAPQEKSLPEFPDSGFHSSLTEQVHSLQHSLDFEKSSTEGSESSIMGNSIDTVRYGKESDLGDVSEEHGEWNKESSNNEQDNSLLEQYLTSVQQLEDADERTNFDTETRDSKLHIACFPVQLDTLSDGASVDESHGISPPLQGEISQTQENSKLNAEVQGQQPECDSTFQLLHVGVTV

SEQ ID NO: 1063 - protein, 291 aa, Homo sapiens
MRLFFEPVTTPCGHSFCKNCLERCLDHAPYCPLCKESLKEYLADRRYCVTQLLEELIVKYLPDELSERKKIYDEETAELSHLTKNVPIFVCTMAYPTVPCPLHVFEPRYRLMIRRSIQTGTKQFGMCVSDTQNSFADYGCMLQIRNVHFLPDGRSVVDTVGGKRFRVLKRGMKDGYCTADIEYLEDVKVENEDEIKNLRELHDLVYSQACSWFQNLRDRFRSQILQHFGSMPEREENLQAAPNGPAWCWWLLAVLPVDPRYQLSVLSMKSLKERLTKIQHILTYFSRDQSK

SEQ ID NO: 1064 - protein, 140 aa, Homo sapiens
MQTGLHVKKDFYLLVWPCPHRGPAWLGADWISVPVVTLHGCPELGCVRLTEQWYTGPHTGLPGTSRAILLYMLYVVCLVFRPGHQVQWDSGRSSSGSVLVLAMRVCSDKNKNQKQGHLFPVLLKQVNCQEGRLCLKLFIT

SEQ ID NO: 1065 - protein, 369 aa, Homo sapiens
MPPMLWLLLHFAAPALGFYFSISCPSGKQCQQALLSGNDILLYCNSSGAHWYYLFTQGKKGRLTSLTNISNMEIMPEGSLLIKDPLPSQTGLYHCWNKNGRQVVQYEIDFQDVTTLHITHKDLGQRPLQNETLHLGSKQLIFTWWEPWQDCNRCEEPGECKRLGYRYIEEPLEEAMPCWLYLGEVLVWSSRLRPELQVEACHVQCTNNTQLRVDYVIFDNFRLDEKTEFVWLDCPLGSMYRPVNWRANDTPLTWESQLSGQDFTTFLDPSTGGRQLQVFQPAVYKCFVQQELVAQFKPAASLETLEAQWRENDAQWREARKALRGRADSVLKGLKLVLLVVTVLALLGALLKCIHPSPGRRSTQVLVVK

SEQ ID NO: 1066 - protein, 411 aa, Homo sapiens
MQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRVRQLREEFDQGLDVVLDDNQNVHDVAALLKEFFRDMKDSLLPDDLYMSFLLTATLKPQDQLSALQLLVYLMPPCHSDTLERLLKALHKITENCEDSIGIDGQLVPGNRMTSTNLALVFGSALLKKGKFGKRESRKTKLGIDHYVASVNVVRAMIDNWDVLFQVPPHIQRQVAKRVWKSSPEALDFIRRRNLRKIQSARIKMEEDALLSDPVETSAEARAAVLAQSKPSDEGSSEEPAVPSGTARSHDDEEGAGNPPIPEQDRPLLRVPREKEAKTGVSYFFP

SEQ ID NO: 1067 - protein, 782 aa, Homo sapiens
MSLRIDVDTNFPECVVDAGKVTLGTQQRQEMDPRLREKQNEIILRAVCALLNSGGGIIKAEIENKGYNYERHGVGLDVPPIFRSHLDKMQKENHFLIFVKSWNTEAGVPLATLCSNLYHRERTSTDVMDSQEALAFLKCRTQTPTNINVSNSLGPQAAQGSVQYEGNINVSAAALFDRKRLQYLEKLNLPESTHVEFVMFSTDVSHCVKDRLPKCVSAFANTEGGYVFFGVHDETCQVIGCEKEKIDLTSLRASIDGCIKKLPVHHFCTQRPEIKYVLNFLEVHDKGALRGYVCAIKVEKFCCAVFAKVPSSWQVKDNRVRQLPTREWTAWMMEADPDLSRCPEMVLQLSLSSATPRSKPVCIHKNSECLKEQQKRYFPVFSDRVVYTPESLYKELFSQHKGLRDLINTEMRPFSQGILIFSQSWAVDLGLQEKQGVICDALLISQNNTPILYTIFSKWDAGCKGYSMIVAYSLKQKLVNKGGYTGRLCITPLVCVLNSDRKAQSVYSSYLQIYPESYNFMTPQHMEALLQSLVIVLLGFKSFLSEELGSEVLNLLTNKQYELLSKNLRKTRELFVHGLPGSGKTILALRIMEKIRNVFHCEPANILYICENQPLKKLVSFSKKNICQPVTRKTFMKNNFEHIQHIIIDDAQNFRTEDGDWYGKAKFITQTARDGPGVLWIFLDYFQTYHLSCSGLPPPSDQYPREEINRVVRNAGPIANYLQQVMQEARQNPPPNLPPGSLVMLYEPKWAQGVPGNLEIIEDLNLEEILIYVANKCRFLLR

SEQ ID NO: 1068 - protein, 907 aa, Homo sapiens
MNAPLDGLSVSSSSTGSLGSAAGAGGGGGAGLRLLSANVRQLHQALTALLSEAEREQFTHCLNAYHARRNVFDLVRTLRVLLDSPVKRRLLPMLRLVIPRSDQLLFDQYTAEGLYLPATTPYRQPAWGGPDSAGPGEVRLVSLRRAKAHEGLGFSIRGGSEHGVGIYVSLVEPGSLAEKEGLRVGDQILRVNDKSLARVTHAEAVKALKGSKKLVLSVYSAGRIPGGYVTNHIYTWVDPQGRSISPPSGLPQPHGGALRQQEGDRRSTLHLLQGGDEKKVNLVLGDGRSLGLTIRGGAEYGLGIYITGVDPGSEAEGSGLKVGDQILEVNGRSFLNILHDEAVRLLKSSRHLILTVKDVGRLPHARTTVDETKWIASSRIRETMANSAGFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPSSPIYASVSPANPSSKRPLDAHLALVNQHPIGPFPRVQSPPHLKSPSAEATVAGGCLLPPSPSGHPDQTGTNQHFVMVEVHRPDSEPDVNEVRALPQTRTASTLSQLSDSGQTLSEDSGVDAGEAEASAPGRGRQSVSTKSRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 1069 - protein, 284 aa, Homo sapiens
MSDNKERKSQGFPKEDNQDTSSLADAVEKVAKQQQSQASEIEKNKKVLFNLKNELHELEKEIAAISAETKETERQIYQQDSAIENTKLHCDSLETQIKSLHSENVKLKFDIETAQEDFEEHMIKYNAYYAKIKAHKNSLGEVESKWSFMTELHEKRDFVKKLKTMKEELMQDLQNPGGNRITQVQEDITNLKDKIITVKESIIEKTCFLEEEKKTHEKLRKEIEGLAPSPRLECSSAISAHCKLCLPGSRHSPASASGVAGTTGACHHTQLIFCIFSRDGVSPC

SEQ ID NO: 1070 - protein, 123 aa, Homo sapiens
MVVSADPLSSERAEMNILEINQELRSQLAESNQQFRDLKEKFLITQATAYSLANQLKKYKCEEYRNHLPPERCRRLKKRKSLRTHWRNVLSLVQIVTTLLTPTSLTGAPKSHLRNTKSTLLWL

SEQ ID NO: 1071 - protein, 381 aa, Homo sapiens
MGCLGGNSKTTEDQGVDEKERREANKKIEKQLQKERLAYKATHRLLLLGAGESGKSTIVKQMRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 1072 - protein, 1077 aa, Homo sapiens
MPRRKQEQPKRLPSHVSRQEEAEGELSEGEHWYGNSSEAPSEASYGEVQENYKLSLEDRIQEQSTSPDTSLGSTTPSSHTLELVALDSEVLRDSLQCQDHLSPGVSSLCDDDPGSNKPLSSNLRRLLEAGSLKLDAAATANGRVESPVNVGSNLSFSPPSHHARQLSVLARKLAEKQEQNDQYTPSNRFIWNQGKWLPNSTTTCSLSPDSAILKLKAAANAVLQDKSLTRTEETMRFESLSSPFSSQSASSTLAALSKKVSERSLTPGQEHPPPASSFLSLASMTSSAALLKEVAARAAGSLLAEKSSLLPEDPLPPPPSEKKPEKVTPPPPPPPPPPPPPPPQSLELLLLPVPKGRVSKPSNSASEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSAANQKEPMNLNFKVKEEPKEGESLSTTLPRSSYVFSPESEVSAPGVSEDALKPQEGKGSVLRRDVSVKAASELLMKLSAESYKETQMVKIKEEPMEVDIQDSHVSISPSRNVGYSTLIGREKTEPLQKMPEGRVPPERNLFSQDISVKMASELLFQLSEKVSKEHNHTKENTIRTTTSPFFSEDTFRQSPFTSNSKELLPSDSVLHGRISAPETEKIVLEAGNGLPSWKFNDQLFPCDVCGKVFGRQQTLSRHLSLHTEERKYKCHLCPYAAKCRANLNQHLTVHSVKLVSTDTEDIVSAVTSEGSDGKKHPYYYSCHVCGFGTELNVQFVSHMSLHVDKEQWMFSICCTACDFVTMEEAEIKTHIGTKHTGEDRKTPSESNSPSSSSLSALSDSANSKDDSDGSQKNKGGNNLLVISVMPGSQPSLNSEEKPEKGFECVFCNFVCKTKNMFERHLQIHLITRMFECDVCHKFMKTPEQLLEHKKCHTVPTGGLK

SEQ ID NO: 1073 - protein, 981 aa, Homo sapiens
MVHHSGSIQSFKQQKGMNISKSEITKETSLKPSRRSLPCLAQSYAYSKSLSQSTSLFQSTESESQAPTSITLISTDKAEQVNTEENKNDSVLRCSFADLSDFCLALGKDKDYTDESEHATYDRSRLINDFVIKDKSEFKTKLSKNDMNYIASSGPLFKDGKRRIDYILVYRKTNIPYDKRNTFEKNLRAEGLMLEKEPAIASPDIMFIKIHIPWDTLCKYAERLNIRMPFRKKCYYTDGRSKSMGRMQTYFRRIKDWMAQNPMVLDKSAFPDLEESDCYTGPFSRARIHHFIINNKDTFFSNATRSRIVYHMLERTKYENGISKVGIRKLINNGSYIAAFPPHEGAYKSSQPIKTHGPQNNRHLLYERWARWGMWYKHQPLDLIRLYFGEKIGLYFAWLGWYTGMLIPAAIVGLCVFFYGLFTMNNSQVSQEICKATEVFMCPLCDKNCSLQRLNDSCIYAKVTYLFDNGGTVFFAIFMAIWATVFLEFWKRRRSILTYTWDLIEWEEEEETLRPQFEAKYYKMEIVNPITGKPEPHQPSSDKVTRLLVSVSGIFFMISLVITAVFGVVVYRLVVMEQFASFKWNFIKQYWQFATSAAAVCINFIIIMLLNLAYEKIAYLLTNLEYPRTESEWENSFALKMFLFQFVNLNSSIFYIAFFLGRFVGHPGKYNKLFDRWRLEECHPSGCLIDLCLQMGVIMFLKQIWNNFMELGYPLIQNWWSRHKIKRGIHDASIPQWENDWNLQPMNLHGLMDEYLEMVLQFGFTTIFVAAFPLAPLLALLNNIIEIRLDAYKFVTQWRRPLPARATDIGIWLGILEGIGILAVITNAFVIAITSDYIPRFVYEYKYGPCANHVEPSENCLKGYVNNSLSFFDLSELGMGKSGYCRYRDYRGPPWSSKPYEFTLQYWHILAARLAFIIVFEHLVFGIKSFIAYLIPDVPKGLHDRIRREKYLVQEMMYEAELEHLQQQRRKSGQPVHHEWP

SEQ ID NO: 1074 - protein, 977 aa, Homo sapiens
MAMALELQAQASPQPEPEELLIVKLELLVLEQFLTILPREVQTWVQARHPESGEEAVALVEDWHRETRTAGQSGLELHTEETRPLKTGEEAQSFQLQPVDPWPEGQSQKKGVKNTCPDLPNHLNAEVAPQPLKESAVLTPRVPTLPKMGSVGDWEVTAESQEALGPGKHAEKELCKDPPGDDCGNSVCLGVPVSKPSNTSEKEQGPEFWGLSLINSGKRSTADYSLDNEPAQALTWRDSRAWEEQYQWDVEDMKVSGVHWGYEETKTFLAILSESPFSEKLRTCHQNRQVYRAIAEQLRARGFLRTLEQCRYRVKNLLRNYRKAKSSHPPGTCPFYEELEALVRARTAIRATDGPGEAVALPRLGDSDAEMDEQEEGGWDPEEMAEDCNGAGLVNVESTQGPRIAGAPALFQSRIAGVHWGYEETKAFLAILSESPFSEKLRTCHQNSQVYRAIAERLCALGFLRTLEQCRYRFKNLLRSYRKAKSSHPPGTCPFYEELDSLMRARAAVRAMGTVREAAGLPRCGQSSAETDAQEAWGEVANEDAVKPSTLCPKAPDMGFEMRHEDEDQISEQDIFEGLPGALSKCPTEAVCQPLDWGEDSENENEDEGQWGNPSQEQWQESSSEEDLEKLIDHQGLYLAEKPYKCDTCMKSFSRSSHFIAHQRIHTGEKPYKCLECGKNFSDRSNLNTHQRIHTGEKPYKCLECGKSFSDHSNLITHQRIHTGEKPYKCGECWKSFNQSSNLLKHQRIHLGGNPDQCSEPGGNFAQSPSFSAHWRNSTEETAPEQPQSISKDLNSPGPHSTNSGEKLYECSECGRSFSKSSALISHQRIHTGEKPYECAECGKSFSKSSTLANHQRTHTGEKPYKCVDCGKCFSERSKLITHQRVHTGEKPYKCLECGKFFRDRSNLITHQRIHTGEKPYKCRECGKCFNQSSSLIIHQRIHTGEKPYKCTECGKDFNNSSHFSAHRRTHAGGKAS

SEQ ID NO: 1075 - protein, 350 aa, Homo sapiens
DIPPLAGKIAALSLSALPVSYALNHVSALSHPLWVALMSALILGLLFVAVYSLSHGEVSYDPLYAVFAVFAFTSVVDLIIALQEDSYVVGFMEFYTKEGEPYLRTAHGVFICYWDGTVHYLLYLAMAGAICRRKRYRNFGLYWLGSFAMSILVFLTGNILGKYSSEIRPAFFLTIPYLLVPCWAGMKVFSQPRALTRCTANMVQEEQRKGLLQRPADLALVIYLILAGFFTLFRGLVVLDCPTDACFVYIYQYEPYLRDPVAYPKVQMLMYMFYVLPFCGLAAYALTFPGCSWLPDWALVFAGGIGQAQFSHMGASMHLRTPFTYRCLQWPAFFHQPPPSDPLALHKKQH

SEQ ID NO: 1076 - protein, 561 aa, Homo sapiens [sequence omitted]

SEQ ID NO: 1077 - protein, 263 aa, Homo sapiens
MNPKMKGFTVSLKSLKHFDCKEKQTLLNQAREDFNQDIGWCVSLITDYRVRLGCGSFAGSFLEYYAADISYPVRKSIQQDVLGTKLPQLSKGSPEEPVVGCPLGQRQPCRKMLPDRSRAARDRANQKLVEYIVKAKGAESHLRAILKSRKPSRWLQTFLSSSQYVTCVETYLEDEGQLDLVVKYLQGVYQEVGAKVLQRTNGDRIRFILDVLLPEAIICAISAVDEVDYKTAEEKYIKGPSLSYREKEIFDNQLLEERNRRRR

SEQ ID NO: 1078 - protein, 644 aa, Homo sapiens
MEAERGPERRPAERSSPGQTPEEGAQALAEFAALHGPALRASGVPERYWGRLLHKLEHEVFDAGEVFGIMQVEEVEEEEDEAAREVRKQQPNPGNELCYKVIVTRESGLQAAHPNSIFLIDHAWTCRVEHARQQLQQVPGLLHRMANLMGIEFHGELPSTEAVALVLEEMWKFNQTYQLAHGTAEEKMPVWYIMDEFGSRIQHADVPSFATAPFFYMPQQVAYTLLWPLRDLDTGEEVTRDFAYGETDPLIRKCMLLPWAPTDMLDLSSCTPEPPAEHYQAILEENKEKLPLDINPVVHPHGHIFKVYTDVQQVASSLTHPRFTLTQSEADADILFNFSHFKDYRKLSQERPGVLLNQFPCENLLTVKDCLASIARRAGGPEGPPWLPRTFNLRTELPQFVSYFQQRERWGEDNHWICKPWNLARSLDTHVTKSLHSIIRHRESTPKVVSKYIESPVLFLREDVGKVKFDIRYIVLLRSVRPLRLFVYDVFWLRFSNRAFALNDLDDYEKHFTVMNYDPDVVLKQVHCEEFIPEFEKQYPEFPWTDVQAEIFRAFTELFQVACAKPPPLGLCDYPSSRAMYAVDLMLKWDNGPDGRRVMQPQILEVNFNPDCERACRYHPTFFNDVFSTLFLDQPGGCHVTCLV

SEQ ID NO: 1079 - protein, 2137 aa, Homo sapiens
EFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGPVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLEPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 1080 - protein, 1838 aa, Homo sapiens
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVPLSLILPLVIVPMVVVIAVSVYCYWRKSQQAEREYEKIKSQLEGLEESVRDRCKKEFTDLMIEMEDQTNDVHEAGIPVLDYKTYTDRVFFLPSKDGDKDVMITGKLDIPEPRRPVVEQALYQFSNLLNSKSFLINFIHTLENQREFSARAKVYFASLLTVALHGKLEYYTDIMHTLFLELLEQYVVAKNPKLMLRRSETVVERMLSNWMSICLYQYLKDSAGEPLYKLFKAIKHQVEKGPVDAVQKKAKYTLNDTGLLGDDVEYAPLTVSVIVQDEGVDAIPVKVLNCDTISQVKEKIIDQVYRGQPCSCWPRPDSVVLEWRPGSTAQILSDLDLTSQQEGRWKRVNTLMHYNVRDGATLILSKVGVSQQPEDSQQDLPGERHALLEEENRVWHLVRPTDEVDEGKSKRGSVKEKERTKAITEIYLTRLLSVKGTLQQFVDNFFQSVLAPGHAVPPAVKYFFDFLDEQAEKHNIQDEDTIHIWKTNSLPLRFWVNILKNPHFIFDVHVHEVVDASLSVIAQTFMDACTRTEHKLSRDSPSNKLLYAKEISTYKKMVEDYYKGIRQMVQVSDQDMNTHLAEISRAHTDSLNTLVALHQLYQYTQKYYDEIINALEEDPAAQKMQLAFRLQQIAAALENKVTDL

SEQ ID NO: 1081 - protein, 677 aa, Homo sapiens
MDFPGHFEQIFQQLNYQRLHGQLCDCVIVVGNRHFKAHRSVLAACSTHFRALFSVAEGDQTMNMIQLDSEVVTAEAFAALIDMMYTSTLMLGESNVMDVLLAASHLHLNSVVKACKHYLTTRTLPMSPPSERVQEQSARMQRSFMLQQLGLSIVSSALNSSQNGEEQPAPMSSSMRSNLDQRTPFPMRRLHKRKQSAEERARQRLRPSIDESAISDVTPENGPSGVHSREEFFSPDSLKIVDNPKADGMTDNQEDSAIMFDQSFGTQEDAQVPSQSDNSAGNMAQLSMASRATQVETSFDQEAAPEKSSFQCENPEVGLGEKEHMRVVVKSEPLSSPEPQDEVSDVTSQAEGSESVEVEGVVVSAEKIDLSPESSDRSFSDPQSSTDRVGDIHILEVTNNLEHKSTFSISNFLNKSRGNNFTANQNNDDNIPNTTSDCRLESEAPYLLSPEAGPAGGPSSAPGSHVENPFSEPADSHFVRPMQEVMGLPCVQTSGYQGGEQFGMDFSRSGLGLHSSFSRVMIGSPRGGASNFPYYRRIAPKMPVVTSVRSSQIPENSTSSQLMMNGATSSFENGHPSQPGPPQLTRASADVLSKCKKALSEHNVLVVEGARKYACKICCKTFLTLTDCKKHIRVHTGEKPYACLKCGKRFSQSSHLYKHSKTTCLRWQSSNLPSTLL

SEQ ID NO: 1082 - protein, 3117 aa, Homo sapiens
MRSSKSKEVPLPNPRNSQSKDTVQADITTSWDALSQTKAALRHIENKLEVAPTSTAVCDSVMDTKKSSTSATRKISRKDGRYLDDSWVNAPISKSTKSRKEKSRSPLRATTLEGNVKKNNRVEFREPLVSYREIHGAPSNFSSSHLESKHVYCVDVNEEKTESGNWMIGSREERNIRSCDFESSQSSVINDTVVRFLNDRPAIDALQNSECLIRMGASMRTEEEMPNRTKGSENNLKLSVNNMAHDTDPKALRLTDSSPSSTSTSNSQRLDILKRRQHDVKLEKLKERIRKQWEHSEETNGRGQKLGHIDHPVMVVNVDNSVTAKVRKVATAPPAPAYKGFNPSETKIRTPDGKVWQEAEFQNMSRELYRDLALHFADDISIKEKPAEKSKEKKVVKPVRKVQKVAQLSSTECRTGSSHLISTSSWRDGQKLVKKILGPAPRMEPKEQRTASSDRGGRRRTAKSGGHIGRAESDPRLDVLHRHLQRNSERSRSKSRSENNIKKLASSLPDNKQEENTALNKDFLPIEIRGILDDLQLDSTAHTAKQDTVELQNQKSSAPVHAPRSHSPVKRKPDKITANEDPPVISKRRHYDTDEVRQYIVRQQEERKRKQNEEKKAQKEATEQKNKRLQELYRKQKEAFTKVKNVPPSEPSATRRLQETYSKLLLEKTLLEEPSHQHVTQETQAKPGYQPSGESDKENKVQERPPSASSSSDMSLSEPPQPLARKDLMESTWMQPERLSPQVHHSQPQPFAGTAGSLLSHLLSLEHVGILHKDFESILPTRKNHNMASRPLTFTPQPYVTSPAAYTDALLKPSASQYKSKLDRIEALKATAASLSSRIESEAKKLAGASINYGSAWNTEYDVQQAPQEDGPWTKAVTPPVKDDNEDVFSARIQKMLGSCVSHATFDDDLPGVGNLSEFKKLPEMIRPQSAISSFRVRSPGPKPQGLLAQLCKRQTDSSSSDMQACSQDKAKISLGSSIDSVSEGPLLSEGSLSEEEGDQDGQPLLKVAEILKEKEFCPGERNSYEPIKEFQKEAEKFLPLFGHIGGTQSKGPWEELAKGSPHSVINIFTKSYQLYGKGFEDKLDRGTSTSRPLNATATPLSGVSYEDDFVSSPGTGTSTEKKSTLEPHSTLSPQEDHSNRKSAYDPSSVDVTSQHSSGAQSAASSRSSTSSKGKKGKKEKTEWLDSFTGNVQNSLLDEEKAERGSHQGKKSGTSSKLSVKDFEQTLDTDSTLEDLSGHSVSVSSDKGRSQKTPTSPLSPSSQKSLQFDVAGTSSERSKSSVMPPTITGFKPNAPLTDLNPAASRTTTENMAPIPGSKRFSPAGLHHRMAAELSYLNAIEESVRQLSDVERVRGISLAQQESVSLAQIIKAQQQRHERDLALLKLKAEQEALESQRQLEETRNKAAQVHAESLQQVVQSQREVTEVLQEATCKIAAQQSETARLTTDAARQICEMAELTRTHISDAVVASGAPLAILYDHQRQHLPDFVKQLRTRTETDRKSPSVSLSQSKEGTLDSKHQKYSASYDSYSESSGYKNHDRRSSSGSSRQESPSVPSCKENEKKLNGEKIESSIDEQVQTAADDSLRSDSVPSLPDEKDSTSIATEYSLKFDESMTEDEIEEQSFRSLLPSESHRRFNMEKRRGHHDDSDEEASPEKTTLSTAKELNMPFSGGQDSFSKFTMEMVRQYMKEEEMRAAHQSSLLRLREKALKEKTKAELAWLEHQKKHLRDKGEDDKMPPLRKKQRGLLLRLQQEKAEIKRLQEANKAARKERQLILKQQEEIEKIRQTTIKLQEKLKSAGESKLDSHSDDDTKDNKATSPGPTDLETRSPSPISISSSETSSIMQKLKKMRSRMDEKFLTKREQKLMQRRQHAEELLEWKRRLDAEEAEIRQMEKQALAAWDKELIKPKTPKKELEDQRTEQKEIASEEESPVPLYSHLNSESSIPEELGSPAVEYVPSESIGQEQPGSPDHSILTEEMICSQELESSTSPSKHSLPKSCTSVSKQESSKGSHRTGGQCHLPIKSHQHCYSWSDESLSMTQSETTSDQSDIEGRIRALKDELRKRKSVVNQLKKEQKKRQKERLKAQEASLIKQLESYDEFIKKTEAELSQDLETSPTAKPQIKTLSSASEKPKIKPLTPLHRSETAKNWKSLTESERSRGSLEPIAEHVDASLSGSERSVSERSLSAYAKRVNEWDSRTEDFQTPSPVLRSSRKIREESGDSLENVPALHLLKELNATSRILDMSDGKVGESSKKSEIKEIEYTKLKKSKIEDAFSKEGKSDVLLKLVLEQGDSSEILSKKDLPLDSENVQKDLVGLAIENLHKSEEMLKERQSDQDMNHSPNIQSGKDIHEQKNTKEKDLSWSEHLFAPKEIPYSEDFEVSSFKKEISAELYKDDFEVSSLLSLRKDSQSCRDKPQPMRSSTSGATSFGSNEEISECLSEKSLSIHSNVHSDRLLELKSPTELMKSKERSDVEHEQQVTESPSLASVPTADELFDFHIGDRVLIGNVQPGILRFKGETSFAKGFWAGVELDKPEGNNNGTYDGIAYFECKEKHGIFAPPQKISHIPENFDDYVDINEDEDCYSDERYQCYNQEQNDTEGPKDREKDVSEYFYEKSLPSVNDIEASVNRSRSLKIETDNVQDISGVLEAHVHQQSSVDSQISSKENKDLISDATEKVSIAAEDDTLDNTFSEELEKQQQFTEEEDNLYAEASEKLCTPLLDLLTREKNQLEAQLKSSLNEEKKSKQQLEKISLLTDSLLKVFVKDTVNQLQQIKKTRDEKIQLSNQELLGDDQKKVTPQDLSQNVEEQSPSISGCFLSSELEDEKEEISSPDMCPRPESPVFGASGQEELAKRLAELELSREFLSALGDDQDWFDEDFGLSSSHKIQKNKAEETIVPLMAEPKRVTQQPCETLLAVPHTAEEVEILVHNAAEELWKWKELGHDLHSISIPTKLLGCASKGLDIESTSKRVYKQAVFDLTKEIFEEIFAEDPNLNQPVWMKPCRINSSYFRRVKNPNNLDEIKSFIASEVLKLFSLKKEPNHKTDWQKMMKFGRKKRDRVDHILVQELHEEEAQWVNYDEDELCVKMQLADGIFETLIKDTIDVLNQISEKQGRMLLV

SEQ ID NO: 1083 - protein, 5183 aa, Homo sapiens
MGNEASLEGEGLPEGLAAAAAAGGGASGAGSPSHTAIPAGMEADLSQLSEEERRQIAAVMSRAQGLPKGSVPPAAAESPSMHRKQELDSSHPPKQSGRPPDPGRPAQPGLSKSRTTDTFRSEQKLPGRSPSTISLKESKSRTDLKEEHKSSMMPGFLSEVNALSAVSSVVNKFNPFDLISDSEASQEETTKKQKVVQKEQGKPEGIIKPPLQQQPPKPIPKQQGPGRDPLQQDGTPKSISSQQPEKIKSQPPGTGKPIQGPTQTPQTDHAKLPLQRDASRPQTKQADIVRGESVKPSLPSPSKPPIQQPTPGKPPAQQPGHEKSQPGPAKPPAQPSGLTKPLAQQPGTVKPPVQPPGTTKPPAQPLGPAKPPAQQTGSEKPSSEQPGPKALAQPPGVGKTPAQQPGPAKPPTQQVGTPKPLAQQPGLQSPAKAPGPTKTPAQTKPPSQQPGSTKPPPQQPGPAKPSPQQPGSTKPPSQQPGSAKPSAQQPSPAKPSAQQFTKPVSQTGFGKPLQPPTVSPSAKQPPSQGLPKTICPLCNTTELLLHVPEKANFNTCTECQTTVCSLCGFNPNPHLTEAKEWLCLNCQMKRALGGDLAPVPSSPQPKLKTAPVTTTSAVSKSSPQPQQTSPKKDAAPKQDLSKAPEPKKPPPLVKQPTLHGSPSAKAKQPPEADSLSKPAPPKEPSVPSEQDKAPVADDKPKQPKMVKPTTDLVSSSSATTKPDIPSSKVQSQAEEKTTPPLKTDSAKPSQSFPPTGEKVTPFDSKAIPRPASDSKIISHPGPSSESKGQKQVDPVQKKEEPKKAQTKMSPKPDAKPMPKGSPTPPGPRPTAGQTVPTPQQSPKPQEQSRRFSLNLGSITDAPKSQPTTPQETVTGKLFGFGASIFSQASNLISTAGQPGPHSQSGPGAPMKQAPAPSQPPTSQGPPKSTGQAPPAPAKSIPVKKETKAPAAEKLEPKAEQAPTVKRTETEKKPPPIKDSKSLTAEPQKAVLPTKLEKSPKPESTCPLCKTELNIGSKDPPNFNTCTECKNQVCNLCGFNPTPHLTENCQTQRAISGQLGDIRKMPPAPSGPKASPMPVPTESSSQKTAVPPQVKLVKKQEQEVKTEAEKVILEKVKETLSMEKIPPMVTTDQKQEESKLEKDKASALQEKKPLPEEKKLIPEEEKIRSEEKKPLLEEKKPTPEDKKLLPEAKTSAPEEQKHDLLKSQVQIAEEKLEGRVAPKTVQEGKQPQTKMEGLPSGTPQSLPKEDDKTTKTIKEQPQPPCTAKPDQEKEDDKSDTSSSQQPKSPQGLSDTGYSSDGISSSLGEIPSLIPTDEKDILKGLKKDSFSQESSPSSPSDLAKLESTVLSILEAQASTLADEKSEKKTQPHEVSPEQPKDQEKTQSLSETLEITISEEEIKESQEERKDTFKKDSQQDIPSSKDHKEKSEFVDDITTRREPYDSVEESSESENSPVPQRKRRTSVGSSSSDEYKQEDSQGSGEEEDFIRKQIIEMSADEDASGSEDDEFIRNQLKEISSSTESQKKEETKGKGKITAGKHRRLTRKSSTSIDEDAGRRHSWHDEDDEAFDESPELKYRETKSQESEELVVTGGGGLRRFKTIELNSTIADKYSAESSQKKTSLYFDEEPELEMESLTDSPEDRSRGEGSSSLHASSFTPGTSPTSVSSLDEDSDSSPSHKKGESKQQRKARHRPHGPLLPTIEDSSEEEELREEEELLKEQEKQREIEQQQRKSSSKKSKKDKDELRAQRRRERPKTPPSNLSPIEDASPTEELRQAAEMEELHRSSCSEYSPSIESDPEGFEISPEKIIEVQKVYKLPTAVSLYSPTDEQSIMQKEGSQKALKSAEEMYEEMMHKTHKYKAFPAANERDEVFEKEPLYGGMLIEDYIYESLVEDTYNGSVDGSLLTRQEEENGFMQQKGREQKIRLSEQIYEDPMQKITDLQKEFYELESLHSVVPQEDIVSSSFIIPESHEIVDLGTMVTSTEEERKLLDADAAYEELMKRQQMQLTPGSSPTQAPIGEDMTESTMDFDRMPDASLTSSVLSGASLTDSTSSATLSIPDVKITQHFSTEEIEDEYVTDYTREIQEIIAHESLILTYSEPSESATSVPPSDTPSLTSSVSSVCTTDSSSPITTLDSITTVYTEPVDMITKFEDSEEISSSTYFPGSIIDYPEEISVSLDRTAPPDGRASADHIVISLSDMASSIIESVVPKPEGPVADTVSTDLLISEKDPVKKAKKETGNGIILEVLEAYRDKKELEAERTKSSLSETVFDHPPSSVIALPMKEQLSTTYFTSGETFGQEKPASQLPSGSPSVSSLPAKPRPFFRSSSLDISAQPPPPPPPPPPPPPPPPPPPPPPLPPPTSPKPTILPKKKLTVASPVTTATPLFDAVTTLETTAVLRSNGLPVTRICTTAPPPVPPKPSSIPSGLVFTHRPEPSKPPIAPKPVIPQLPTTTQKPTDIHPKPTGLSLTSSMTLNLVTSADYKLPSPTSPLSPHSNKSSPRFSKSLTETYVVITLPSEPGTPTDSSASQAITSWPLGSPSKDLVSVEPVFSVVPPVTAVEIPISSEQTFYISGALQTFSATPVTAPSSFQAAPTSVTQFLTTEVSKTEVSATRSTAPSVGLSSISITIPPEPLALDNIHLEKPQYKEDGKLQLVGDVIDLRTVPKVEVKTTDKCIDLSASTMDVKRQITANEVYGKQISAVQPSIINLSVTSSIVTPVSLATETVTFVTCTASASYTTGTESLVGAEHAMTTPLQLTTSKHAEPPYRIPSDQVFPIAREEAPINLSLGTPAHAVTLAITKPVTVPPVGVTNGWTDSTVSQGITDGEVVDLSTTKSHRTVVTMDESTSSVMTKIIEDEKPVDLTAGRRAVCCDVVYKLPFGRSCTAQQPATTLPEDRFGYRDDHYQYDRSGPYGYRGIGGMKPSMSDTNLAEAGHFFYKSKNAFDYSEGTDTAVDLTSGRVTTGEVMDYSSKTTGPYPETRQVISGAGISTPQYSTARMTPPPGPQYCVGSVLRSSNGVVYSSVATPTPSTFAITTQPGSIFSTTVRDLSGIHTADAVTSLPAMHHSQPMPRSYFITTGASETDIAVTGIDISASLQTITMESLTAETIDSVPTLTTASEVFPEVVGDESALLIVPEEDKQQQQLDLERELLELEKIKQQRFAEELEWERQEIQRFREQEKIMVQKKLEELQSMKQHLLFQQEEERQAQFMMRQETLAQQQLQLEQIQQLQQQLHQQLEEQKIRQIYQYNYDPSGTASPQTTTEQAILEGQYAALEGSQFWATEDATTTASAVVAIEIPQSQGWYTVQSDGVTQYIAPPGILSTVSEIPLTDVVVKEEKQPKKRSSGAKVRGQYDDMGENMTDDPRSFKKIVDSGVQTDDEDATDRSYVSRRRRTKKSVDTSVQTDDEDQDEWDMPTRSRRKARVGKYGDSMTEADKTKPLSKVSSIAVQTVAEISVQTEPVGTIRTPSIRARVDAKVEIIKHISAPEKTYKGGSLGCQTEADSDTQSPQYLSATSPPKDKKRPTPLEIGYSSHLRADSTVQLAPSPPKSPKVLYSPISPLSPGKALESAFVPYEKPLPDDISPQKVLHPDMAKVPPASPKTAKMMQRSMSDPKPLSPTADESSRAPFQYTEGYTTKGSQTMTSSGAQKKVKRTLPNPPPEEISTGTQSTFSTMGTVSRRRICRTNTMARAKILQDIDRELDLVERESAKLRKKQAELDEEEKEIDAKLRYLEMGINRRKEALLKEREKRERAYLQGVAEDRDYMSDSEVSSTRPTRIESQHGIERPRTAPQTEFSQFIPPQTQTESQLVPPTSPYTQYQYSSPALPTQAPTSYTQQSHFEQQTLYHQQVSPYQTQPTFQAVATMSFTPQVQPTPTPQPSYQLPSQMMVIQQKPRQTTLYLEPKITSNYEVIRNQPLMIAPVSTDNTFAVSHLGSKYNSLDLRIGLEERSSMASSPISSISADSFYADIDHHTPRNYVLIDDIGEITKGTAALSTAFSLHEKDLSKTDRLLRTTETRRSQEVTDFLAPLQSSSRLHSYVKAEEDPMEDPYELKLLKHQIKQEFRRGTESLDHLAGLSHYYHADTSYRHFPKSEKYSISRLTLEKQAAKQLPAAILYQKQSKHKKSLIDPKMSKFSPIQESRDLEPDYSSYMTSSTSSIGGISSRARLLQDDITFGLRKNITDQQKFMGSSLGTGLGTLGNTIRSALQDEADKPYSSGSRSRPSSRPSSVYGLDLSIKRDSSSSSLRLKAQEAEALDVSFSHASSSARTKPTSLPISQSRGRIPIVAQNSEEESPLSPVGQPMGMARAAAGPLPPISADTRDQFGSSHSLPEVQQHMREESRTRGYDRDIAFIMDDFQHAMSDSEAYHLRREETDWFDKPRESRLENGHGLDRKLPERLVHSRPLSQHQEQIIQMNGKTMHYIFPHARIKITRDSKDHTVSMQVLEWNGIPLTSKTYEEVQSIISQQSGEAEICVRLDLNMLSDSENSQHLELHEPPKAVDKAKSPGVDPKQLAAELQKVSLQQSPLVLSSVVEKGSHVHSGPTSAGSSSVPSPGQPGSPSVSKKKHGSSKLQINYDLGNLIIHILQARNLVPRDNNGYSDPFVKVYLLPGRGAEYKRRTKHVQKSLNPEWNQTVIYKSISMEQLKKKTLEVTVWDYDRFSSNDFLGEVLIDLSSTSHLDNTPRWYPLKEQTESIDHGKSHSSQSSQQSPKPSVIKSRSHGIFPDPSKDMQVPTIEKSHSSPGSSKSSSEGHLRSHGPSRSQSKTSVTQTHLEDAGAAIAAAEAAVQQLRIQPTAHKSGQSNHARKQHRHSIAGVLPIQRTQSDNLPPPANGNQDQSQLALRKVMSDGPVKPEGAKPPNHRPAESSVSTGSSGSSFGSGYSVDSEGSSSTAGETNLFPIPRIGKMGQNGQEPVKQPGVGVGLADTEARGQREPKPGQACFLGARNMKEIQPMPEIYPETDKDGEKYPGSLFLPFSNLCQCLIKTNWKPVDGEAQADLELLPNLQTRRILPPSMYLLQKTKALQTYKRSDIRGSNGPTINATTCFETTSVMGEIKIALKKEMKTDGEQLIVEILQCRNITYKFKSPDHLPDLYVKIYVMNISTQKKVIKKKTRVCRHDREPSFNETFRFSLSPAGHSLQILLFSNGGKFMKKTLIGEACIWLDKVDLRKRIVNWHKLLVSPTQTH

SEQ ID NO: 1084 - protein, 1521 aa, Homo sapiens
RRGVKRPGSNLREVDQGCRCPERSFSFHWSGGKSAAMAAPAQPKKIVAPTVSQINAEFVTQLACKYWAPHIKKKSPFDIKVIEDIYEKEIVKSRFAIRKIMLLEFSQYLENYLWMNYSPEVSSKAYLMSICCMVNEKFRENVPAWEIFKKKPDHFPFFFKHILKAALAETDGEFSLHEQTVLLLFLDHCFNSLEVDLIRSQVQQLISLPMWMGLQLARLELELKKTPKLRKFWNLIKKNDEKMDPEAREQAYQERRFLSQLIQKFISVLKSVPLSEPVTMDKVHYCERFIELMIDLEALLPTRRWFNTILDDSHLLVHCYLSNLVRREEDGHLFSQLLDMLKFYTGFEINDQTGNALTENEMTTIHYDRITSLQRAAFAHFPELYDFALSNVAEVDTRESLVKFFGPLSSNTLHQVASYLCLLPTLPKNEDTTFDKEFLLELLVSRHERRISQIQQLNQMPLYPTEKIIWDENIVPTEYYSGEGCLALPKLNLQFLTLHDYLLRNFNLFRLESTYEIRQDIEDSVSRMKPWQSEYGGVVFGGWARMAQPIVAFTVVEVAKPNIGENWPTRVRADVTINLNVRDHIKDEWEGLRKHDVCFLITVRPTKPYGTKFDRRRPFIEQVGLVYVRGCEIQGMLDDKGRVIEDGPEPRPNLRGESRTFRVFLDPNQYQQDMTNTIQNGAEDVYETFNIIMRRKPKENNFKAVLETIRNLMNTDCVVPDWLHDIILGYGDPSSAHYSKMPNQIATLDFNDTFLSIEHLKASFPGHNVKVTVEDPALQIPPFRITFPVRSGKGKKRKDADVEDEDTEEAKTLIVEPHVIPNRGPYPYNQPKRNTIQFTHTQIEAIRAGMQPGLTMVVGPPGTGKTDVAVQIISNIYHNFPEQRTLIVTHSNQALNQLFEKIMALDIDERHLLRLGHGEEELETEKDFSRYGRVNYVLARRIELLEEVKRLQKSLGVPGDASYTCETAGYFFLYQVMSRWEEYISKVKNKGSTLPDVTEVSTFFPFHEYFANAPQPIFKGRSYEEDMEIAEGCFRHIKKIFTQLEEFRASELLRSGLDRSKYLLVKEAKIIAMTCTHAALKRHDLVKLGFKYDNILMEEAAQILEIETFIPLLLQNPQDGFSRLKRWIMIGDHHQLPPVIKNMAFQKYSNMEQSLFTRFVRVGVPTVDLDAQGRARASLCNLYNWRYKNLGNLPHVQLLPEFSTANAGLLYDFQLINVEDFQGVGESEPNPYFYQNLGEAEYVVALFMYMCLLGYPADKISILTTYNGQKHLIRDIINRRCGNNPLIGRPNKVTTVDRFQGQQNDYILLSLVRTRAVGHLRDVRRLVVAMSRARLGLYIFARVSLFQNCFELTPAFSQLTARPLHLHIIPTEPFPTTRKNGERPSHEVQIIKNMPQMANFVYNMYMHLIQTTHHYHQTLLQLPPAMVEEGEEVQNQETELETEEEAMTVQADIIPSPTDTSCRQETPAFQTDTTPSETGATSTPEAIPALSETTPTVVGAVSAPAEANTPQDATSAPEETK

SEQ ID NO: 1085 - protein, 510 aa, Homo sapiens
MTMLGRYLDNVVNKQSVSPPIPHLRALLSSSDDPPAEVDIFELLKVSYEKFSSLRAEDIEQMRFKQRLKVIQSLEDTAKRSVVRAIPVDIGFSIEELEDLYMVFKAKHLASQYWGCSRTMAGRRDPSLPYLEQYRIDASQFRELFASLTPWACGSHTPLLAGRMFRLLDENKDSLINFKEFVTGMSGMYHGDLTEKLKVLYKLHLPPALSPEEAESALEAAHYFTEDSSSEEALPQEEQEGSGSEERGEEKGTSSPDYRHYLRMWAKEKEAQKETIKDLPKMNQEQFIELCKTLYNMFSEDPMEQDLYHAIATVASLLLRIGEVGKKFSARTGRKPRDCATEEDEPPAPELHQDAARELQPPAAGDPQAKAGGDTHLGTAPQESQVVVEGGSGEGQGSPSQLLSDDETKDDMSMSSYSVVSTGSLQCEDLADDTVLVGGEACSPTARIGGTVDTDWCISFEQILASILTESVLVNFFEKRVDIGLKIKDQKKVERQFSTASDHEQPGVSG

SEQ ID NO: 1086 - protein, 957 aa, Homo sapiens
MHVCCPPVTLEQDLHRKMHSWMLQTLAFAVTSLVLSCAETIDYYGEICDNACPCEEKDGILTVSCENRGIISLSEISPPRFPIYHLLLSGNLLSRLYPNEFVNYTGASILHLGSNVIQDIETGAFHGLRGLRRLHLNNNKLELLRDDTFLGLENLEYLQVDYNYISVIEPNAFGKLHMLQVLILNDNLLSGLPNNLFRFVPLTHLDLRGNRLKLLPYVGLLQHMDKVVELQLEENPWNCSCELISLKDWLDSISYSALVGDVVCETPFRLHGRDLDEVSKQELCPRKLISDYEMRPQTPLSTTGYLHTTPASVNSVATSSSAVYKPPLKPPKGTRQPNKPRVRPTSRQPSKDLGYSNYGPSIAYQTKSPVPLECPTACTCNLQISDLGLNVNCQERKIESIAELQPKPYNPKKMYLTENYITVVRRTDFLEATGLDLLHLGNNRISMIQDRAFGDLGNLRRLYLNGNRIERLSPELFYGLQSLQYLFLQYNLIREIQAGTFDPVPNLQLLFLNNNQLQAMPSGVFSGLTLLRLNLRGNSFTSLPVSGVLDQLTSLIQIDLHDNPWDCTCDVVGMKLWIEQLKVGVLVDEVICKAPKKFAETYMRSIKSELLCPDYSDVVVSTPTPSSIQVPSRTNAATPAVRLNSTGTPAGLGAGTGASSVPLSVLILSLLLVFIMSVFVAAGLFVLVMKRRKKNQSDHTSTNNSDVSSFNMQYSVYGGGGGGGGGHPHAHVHHRGPALPKVKTPAGHVYEYIPHPLGHMCKNPIYRSREGNSVEDYKDLHELKVTYSSNHHLQQQPPPPPQQPQQQPPPQMQMQPGEEERRESHHLRSPAYSVSTIEPREDLLSPVQDADRFYRGILEPDKHCSTTPAGSSLPEYPKFPCSPAAYTFSPNYDLRRPHQYLHPGAGESRLREPVLYSPPGAVFVEPNRNEYLELKAKLNVEPDYLEVLEKQTTFSQF

SEQ ID NO: 1087 - protein, 1504 aa, Homo sapiens [sequence omitted]

SEQ ID NO: 1088 - protein, 1024 aa, Homo sapiens
MTEGRRCQVHLLDDRKLELLVQPKLLAKELLDLVASHFNLKEKEYFGIAFTDETGHLNWLQLDRRVLEHDFPKKSGPVVLYFCVRFYIESISYLKDNATIELFFLNAKSCIYKELIDVDSEVVFELASYILQEAKGDFSSNEVVRSDLKKLPALPTQALKEHPSLAYCEDRVIEHYKKLNGQTRGQAIVNYMSIVESLPTYGVHYYAVKDKQGIPWWLGLSYKGIFQYDYHDKVKPRKIFQWRQLENLYFREKKFSVEVHDPRRASVTRRTFGHSGIAVHTWYACPALIKSIWAMAISQHQFYLDRKQSKSKIHAARSLSEIAIDLTETGTLKTSKLANMGSKGKIISGSSGSLLSSGSQESDSSQSAKKDMLAALKSRQEALEETLRQRLEELKKLCLREAELTGKLPVEYPLDPGEEPPIVRRRIGTAFKLDEQKILPKGEEAELERLEREFAIQSQITEAARRLASDPNVSKKLKKQRKTSYLNALKKLQEIENAINENRIKSGKKPTQRASLIIDDGNIASEDSSLSDALVLEDEDSQVTSTISPLHSPHKGLPPRPPSHNRPPPPQSLEGLRQMHYHRNDYDKSPIKPKMWSESSLDEPYEKVKKRSSHSHSSSHKRFPSTGSCAEAGGGSNSLQNSPIRGLPHWNSQSSMPSTPDLRVRSPHYVHSTRSVDISPTRLHSLALHFRHRSSSLESQGKLLGSENDTGSPDFYTPRTRSSNGSDPMDDCSSCTSHSSSEHYYPAQMNANYSTLAEDSPSKARQRQRQRQRAAGALGSASSGSMPNLAARGGAGGAGGAGGGVYLHSQSQPSSQYRIKEYPLYIEGGATPVVVRSLESDQECHYSVKAQFKTSNSYTAGGLFKESWRGGGGDEGDTGRLTPSRSQILRTPSLGREGAHDKGAGRAAVSDELRQWYQRSTASHKEHSRLSHTSSTSSDSGSQYSTSSQSTFVAHSRVTRMPQMCKATSAALPQSQRSSTPSSEIGATPPSSPHHILTWQTGEATENSPILDGSESPPHQSTDE

SEQ ID NO: 1089 - protein, 716 aa, Homo sapiens
MARMSFVIAACQLVLGLLMTSLTESSIQNSECPQLCVCEIRPWFTPQSTYREATTVDCNDLRLTRIPSNLSSDTQVLLLQSNNIAKTVDELQQLFNLTELDFSQNNFTNIKEVGLANLTQLTTLHLEENQITEMTDYCLQDLSNLQELYINHNQISTISAHAFAGLKNLLRLHLNSNKLKVIDSRWFDSTPNLEILMIGENPVIGILDMNFKPLANLRSLVLAGMYLTDIPGNALVGLDSLESLSFYDNKLVKVPQLALQKVPNLKFLDLNKNPIHKIQEGDFKNMLRLKELGINNMGELVSVDRYALDNLPELTKLEATNNPKLSYIHRLAFRSVPALESLMLNNNALNAIYQKTVESLPNLREISIHSNPLRCDCVIHWINSNKTNIRFMEPLSMFCAMPPEYKGHQVKEVLIQDSSEQCLPMISHDSFPNRLNVDIGTTVFLDCRAMAEPEPEIYWVTPIGNKITVETLSDKYKLSSEGTLEISNIQIEDSGRYTCVAQNVQGADTRVATIKVNGTLLDGTQVLKIYVKQTESHSILVSWKVNSNVMTSNLKWSSATMKIDNPHITYTARVPVDVHEYNLTHLQPSTDYEVCLTVSNIHQQTQKSCVNVTTKNAAFAVDISDQETSTALAAVMGSMFAVISLASIAVYFAKRFKRKNYHHSLKKYMQKTSSIPLNELYPPLINLWEGDSEKDKDGSADTKPTQVDTSRSYYMW

SEQ ID NO: 1090 - protein, 2010 aa, Homo sapiens
CVAQAGLELLSLSDVSAWASQSAGITDMSGNKRGSRASCPHRGAECLLPWAALNLQGFQLLLLHPSATAMMDVSELGESARYLRQGYQEMTKVHTIPWDGKKRVWVPDEQDAYVEAEVKSEATGGRVTVETKDQKVLMVREAELQPMNPPRFDLLEDMAMMTHLNEASVLHNLRQRYARWMIYTYSGLFCVTINPYKWLPVYTASVVAAYKGKRRSDSPPHIYAVADNAYNDMLRNRDNQSMLITGESGAGKTVNTKRVIQYFAIVAALGDGPGKKAQFLATKTGGTLEDQIIEANPAMEAFGNAKTLRNDNSSRFGKFIRIHFGPSGKLASADIDSYLLEKSRVIFQLPGERSYHVYYQILSGRKPELQDMLLLSMNPYDYHFCSQGVITVDNMNDGEELIATDHAMDILGFSVDEKCACYKIVGALLHFGNMKFKQKQREEQAEADGTESADKAAYLMGVSSGDLLKGLLHPRVRVGNEYVTKGQSVEQVVFAVGALAKATYDRLFRWLVSRINQTLDTKLPRQFFIGVLDIAGFEIFEFNSFEQLCINFTNEKLQQFFNQHMFVLEQEEYKREGIDWVFIDFGLDLQPCIDLIEKPLGILSILEEECMFPKASDASFRAKLYDNHAGKSPNFQQPRPDKKRKYQAHFEVVHYAGVVPYSIVGWLEKNKDPLNETVVPIFQKSQNRLLATLYENYAGSCSTEPPKSGVKEKRKKAASFQTVSQLHKENLNKLMTNLRATQPHFVRCIVPNENKTPGVMDAFLVLHQLRCNGVLEGIRICRQGFPNRLLYTDFRQRYRILNPSAIPDDTFMDSRKATEKLLGSLDLDHTQYQFGHTKVFFKAGLLGVLEELRDQRLAKVLTLLQARSRGRLMRLEYQRLLGGRDALFTIQWNIRAFNAVKNWSWMKLFFKMKPLLRSAQAEEELAALRAELRGLRGALAAAEAKRQELEETHVSITQEKNDLALQLQAEQDNLADAEERCHLLIKSKVQLEGKVKELSERLEDEEEVNADLAARRRKLEDECTELKKDIDDLELTLAKAEKEKQATENKVKNLTEEMAALDESVARLTKEKKALQEAHQQALGDLQAEEDRVSALTKAKLRLEQQVEDLECSLEQEKKLRMDTERAKRKLEGDLKLTQESVADAAQDKQQLEEKLKKKDSELSQLSLRVEDEQLLGAQMQKKIKELQARAEELEEELEAERAARARVEKQRAEAARELEELSERLEEAGGASAGQREGCRKREAELGRLRRELEEAALRHEATVAALRRKQAEGAAELGEQVDSLQRVRQKLEKEKSELRMEVDDLAANVETLTRAKASAEKLCRTYEDQLSEAKIKVEELQRQLADASTQRGRLQTESGELSRLLEEKECLISQLSRGKALAAQSLEELRRQLEEESKAKSALAHAVQALRHDCDLLREQHEEEAEAQAELQRLLSKANAEVAQWRSKYEADAIQRTEELEEAKKKLALRLQEAEEGVEAANAKCSSLEKAKLRLQTESEDVTLELERATSAAAALDKKQRHLERALEERRRQEEEMQRELEAAQRESRGLGTELFRLRHGHEEALEALETLKRENKNLQEEISDLTDQVSLSGKSIQELEKTKKALEGEKSEIQAALEEAEGALELEETKTLRIQLELSQVKAEVDRKLAEKDEECANLRRNHQRAVESLQASLDAETRARNEALRLKKKMEGDLNDLELQLGHATRQATEAQAATRLMQAQLKEEQAGRDEEQRLAAELHEQAQALERRASLLAAELEELRAALEQGERSRRLAEQELLEATERLNLLHSQNTGLLNQKKKLEADLAQLSGEVEEAAQERREAEEKAKKAITDAAMMAEELKKEQDTSAHLERMKKTLEQTVRELQARLEEAEQAALRGGKKQVQKLEAKVRELEAELDAEQKKHAEALKGVRKHERRVKELAYQAEEDRKNLARMQDLVDKLQSKVKSYKRQFEEAEQQANTNLAKYRKAQHELDDAEERADMAETQANKLRARTRDALGPKHKE

SEQ ID NO: 1091 - protein, 446 aa, Homo sapiens
QLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILASQ

SEQ ID NO: 1092 - protein, 747 aa, Homo sapiens [sequence omitted]

SEQ ID NO: 1093 - protein, 787 aa, Homo sapiens
GKEAEAWAKPGAAARRSLLEPPRRLSLGAGSGPARRRTQDGGCMPEDQAGAAMEEASPYSLLDICLNFLTTHLEKFCSARQDGTLCLQEPGVFPQEVADRLLRTMAFHGLLNDGTVGIFRGNQMRLKRACIRKAKISAVAFRKAFCHHKLVELDATGVNADITITDIISGLGSNKWIQQNLQCLVLNSLTLSLEDPYERCFSRLSGLRALSITNVLFYNEDLAEVASLPRLESLDISNTSITDITALLACKDRLKSLTMHHLKCLKMTTTQILDVVRELKHLNHLDISDDKQFTSDIALRLLEQKDILPNLVSLDVSGRKHVTDKAVEAFIQQRPSMQFVGLLATDAGYSEFLTGEGHLKVSGEANETQIAEALKRYSERAFFVREALFHLFSLTHVMEKTKPEILKLVVTGMRNHPMNLPVQLAASACVFNLTKQDLAAGMPVRLLADVTHLLLKAMEHFPNHQQLQKNCLLSLCSDRILQDVPFNRFEAAKLVMQWLCNHEDQNMQRMAVAIISILAAKLSTEQTAQLGTELFIVRQLLQIVKQKTNQNSVDTTLKFTLSALWNLTDESPTTCRHFIENQGLELFMRVLESFPTESSIQQKVLGLLNNIAEVQELHSELMWKDFIDHISSLLHSVEVEVSYFAAGIIAHLISRGEQAWTLSRSQRNSLLDDLHSAILKWPTPECEMVAYRSFNPFFPLLGCFTTPGVQLWAVWAMQHVCSKNPSRYCSMLIEEGGLQHLYNIKDHEHTDPHVQQIAVAILDSLEKHIVRHGRPPPCKKQPQARLN

SEQ ID NO: 1094 - protein, 400 aa, Homo sapiens
LTSTAFGNMDKFPFNWKLKSHILDSSIYSNRPKVQTLFYVTGMGWDDSDLTEDLPCVKMFAFPEAREVAASCRLQGAPGLCVAELELLPEWFSSGLDLEPEEEIPALLGGTTMELFFTLYPADKAGQCPLEEEGKWENNIHSGLESPQQAFPARERIGSVVVYPTQDDLKWSLVSLDENVVISVPLNLVREGDTATFLVSLTSSSVADQFTLRIKAAAGVKITAVRVSSEDQWAVQEEIDNGSTQTSATLTCMGHRPDTQSRVNGSFYEILQVDFGIDNSSDLAGAQQITWQVEYPIEDSMSELVVSEIFVSQTTFVGIVPLAMDTEVLNTAILTGKPVSVPVKVVGVQEDGSVVDVSESVECKSADEDVIKVRGDLSTAVLSAQSFLSFLLLSPRSCSH

SEQ ID NO: 1095 - protein, 475 aa, Homo sapiens [sequence omitted]

SEQ ID NO: 1096 - protein, 371 aa, Homo sapiens
MAAEPQPSSLSYRTTGSTYLHPLSELLGIPLDQVNFVVCQLVALFAAFWFRIYLRPGTTSSDVRHAVATIFGIYFVIFCFGWYSVHLFVLVLMCYAIMVTASVSNIHRYSFFVAMGYLTICHISRIYIFHYGILTTDFSGPLMIVTQKITTLAFQVHDGLGRRAEDLSAEQHRLAIKVKPSFLEYLSYLLNFMSVIAGPCNNFKDYIAFIEGKHIHMKLLEVNWKRKGFHSLPEPSPTGAVIHKLGITLVSLLLFLTLTKTFPVTCLVDDWFVHKASFPARLCYLYVVMQASKPKYYFAWTLADAVNNAAGFGFSGVDKNGNFCWDLLSNLNIWKIETATSFKMYLENWNIQTATWLKCVCYQRVHGTPRC

SEQ ID NO: 1097 - protein, 468 aa, Homo sapiens; identical to SEQ ID NO: 804

SEQ ID NO: 1098 - protein, 1332 aa, Homo sapiens
MRNLKLFRTLEFRDIQGPGNPQCFSLRTEQGTVLIGSEHGLIEVDPVSREVKNEVSLVAEGFLPEDGSGRIVGVQDLLDQESVCVATASGDVILCSLSTQQLECVGSVASGISVMSWSPDQELVLLATGQQTLIMMTKDFEPILEQQIHQDDFGESKFITVGWGRKETQFHGSEGRQAAFQMQMHESALPWDDHRPQVTWRGDGQFFAVSVVCPETGARKVRVWNREFALQSTSEPVAGLGPALAWKPSGSLIASTQDKPNQQDIVFFEKNGLLHGHFTLPFLKDEVKVNDLLWNADSSVLAVRLEDLQREKSSIPKTCVQLWTVGNYHWYLKQSLSFSTCGKSKIVSLMWDPVTPYRLHVLCQGWHYLAYDWHWTTDRSVGDNSSDLSNVAVIDGNRVLVTVFRQTVVPPPMCTYQLLFPHPVNQVTFLAHPQKSNDLAVLDASNQISVYKCGDCPSADPTVKLGAVGGSGFKVCLRTPHLEKRYKIQFENNEDQDVNPLKLGLLTWIEEDVFLAVSHSEFSPRSVIHHLTAASSEMDEEHGQLNVSSSAAVDGVIISLCCNSKTKSVVLQLADGQIFKYLWESPSLAIKPWKNSGGFPVRFPYPCTQTELAMIGEEECVLGLTDRCRFFINDIEVASNITSFAVYDEFLLLTTHSHTCQCFCLRDASFKTLQAGLSSNHVSHGEVLRKVERGSRIVTVVPQDTKLVLQMPRGNLEVVHHRALVLAQIRKWLDKLMFKEAFECMRKLRINLNPIYDHNPKVFLGNVETFIKQIDSVNHINLFFTELKEEDVTKTMYPAPVTSSVYLSRDPDGNKIDLVCDAMRAVMESINPHKYCLSILTSHVKKTTPELEIVLQKVHELQGNAPSDPDAVSAEEALKYLLHLVDVNELYDHSLGTYDFDLVLMVAEKSQKDPKEYLPFLNTLKKMETNYQRFTIDKYLKRYEKAIGHLSKCGPEYFPECLNLIKDKNLYNEALKLYSPSSQQYQDISIAYGEHLMQEHMYEPAGLMFARCGAHEKALSAFLTCGNWKQALCVAAQLNFTKDQLVGLGRTLAGKLVEQRKHIDAAMVLEESAQDYEEAVLLLLEGAAWEEALRLVYKYNRLDIIETNVKPSILEAQKNYMAFLDSQTATFSRHKKRLLVVRELKEQAQQAGLDDEVPHGQESDLFSETSSVVSGSEMSGKYSHSNSRISARSSKNRRKAERKKHSLKEGSPLEDLALLEALSEVVQNTENLKDEVYHILKVLFLFEFDEQGRELQKAFEDTLQLMERSLPEIWTLTYQQNSATPVLGPNSTANSIMASYQQQKTSVPVLDAELFIPPKINRRTQWKLSLLD

SEQ ID NO: 1099 - protein, 205 aa, Homo sapiens
MWLLPALLLLCLSGCLSLTGPGSVTGTAGDSLTVWCQYESMYKGYNKYWCRGQYDTSCESIVETKGEEKVERNGRVSIRDHPEALAFTVTMQNLNEDDAGSYWCKIQTVWVLDSWSRDPSDLVRVYVSPAITTPRRTTHPATPPIFLVVNPGRNLSTGEVLTQNSGFRLSSPHFLLVVLLKLPLLLSMLGAVFWVNRPQWAPPGR

SEQ ID NO: 1100 - protein, 829 aa, Homo sapiens
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 1101 - protein, 2623 aa, Homo sapiens
MKVKGRGITCLLVSFAVICLVATPGGKACPRRCACYMPTEVHCTFRYLTSIPDSIPPNVERINLGYNSLVRLMETDFSGLTKLELLMLHSNGIHTIPDKTFSDLQALQVLKMSYNKVRKLQKDTFYGLRSLTRLHMDHNNIEFINPEVFYGLNFLRLVHLEGNQLTKLHPDTFVSLSYLQIFKISFIKFLYLSDNFLTSLPQEMVSYMPDLDSLYLHGNPWTCDCHLKWLSDWIQEKPDVIKCKKDRSPSSAQQCPLCMNPRTSKGKPLAMVSAAAFQCAKPTIDSSLKSKSLTILEDSSSAFISPQGFMAPFGSLTLNMTDQSGNEANMVCSIQKPSRTSPIAFTEENDYIVLNTSFSTFLVCNIDYGHIQPVWQILALYSDSPLILERSHLLSETPQLYYKYKQVAPKPEDIFTNIEADLRADPSWLMQDQISLQLNRTATTFSTLQIQYSSDAQITLPRAEMRPVKHKWTMISRDNNTKLEHTVLVGGTVGLNCPGQGDPTPHVDWLLADGSKVRAPYVSEDGRILIDKSGKLELQMADSFDTGVYHCISSNYDDADILTYRITVVEPLVEAYQENGIHHTVFIGETLDLPCHSTGIPDASISWVIPGNNVLYQSSRDKKVLNNGTLRILQVTPKDQGYYRCVAANPSGVDFLIFQVSVKMKGQRPLEHDGETEGSGLDESNPIAHLKEPPGAQLRTSALMEAEVGKHTSSTSKRHNYRELTLQRRGDSTHRRFRENRRHFPPSARRIDPQHWAALLEKAKKNAMPDKRENTTVSPPPVVTQLPNIPGEEDDSSGMLALHEEFMVPATKALNLPARTVTADSRTISDSPMTNINYGTEFSPVVNSQILPPEEPTDFKLSTAIKTTAMSKNINPTMSSQIQGTTNQHSSTVFPLLLGATEFQDSDQMGRGREHFQSRPPITVRTMIKDVNVKMLSSTTNKLLLESVNTTNSHQTSVREVSEPRHNHFYSHTTQILSTSTFPSDPHTAAHSQFPIPRNSTVNIPLFRRFGRQRKIGGRGRIISPYRTPVLRRHRYSIFRSTTRGSSEKSTTAFSATVLNVTCLSCLPRERLTTATAALSFPSAAPITFPKADIARVPSEESTTLVQNPLLLLENKPSVEKTTPTIKYFRTEISQVTPTGAVMTYAPTSIPMEKTHKVNASYPRVSSTNEAKRDSVITSSLSGAITKPPMTIIAITRFSRRKIPWQQNFVNNHNPKGRLRNQHKVSLQKSTAVMLPKTSPALPRDKVSPFHFTTLSTSVMQIPSNTLTTAHHTTTKTHNPGSLPTKKELPFPPLNPMLPSIISKDSSTKSIISTQTAIPATTPTFPASVITYETQTERSRAQTIQREQEPQKKNRTDPNISPDQSSGFTTPTAMTPPVLTTAETSVKPSVSAFTHSPPENTTGISSTISFHSRTLNLTDVIEELAQASTQTLKSTIASETTLSSKSHQSTTTRKAIIRHSTIPPFLSSSATLMPVPISPPFTQRAVTDNVATPISGLMTNTVVKLHESSRHNAKPQQLVAEVATSPKVHPNAKFTIGTTHFIYSNLLHSTPMPALTTVKSQNSKLTPSPWAENQFWHKPYSEIAEKGKKPEVSMLATTGLSEATTLVSDWDGQKNTKKSDFDKKPVQEATTSKLLPFDSLSRYIFEKPRIVGGKAASFTIPANSDAFLPCEAVGNPLPTIHWTRVPSGLDLSKRKQNSRVQVLPNGTLSIQRVEIQDRGQYLCSASNLFGTDHLHVTLSVVSYPPRILERRTKEITVHSGSTVELKCRAEGRPSPTVTWILANQTVVSESSQGSRQAVVTVDGTLVLHNLSIYDRGFYKCVASNPGGQDSLLVKIQVIAAPPVILEQRRQVIVGTWGESLKLPCTAKGTPQPSVYWVLSDGTEVKPLQFTNSKLFLFSNGTLYIRNLASSDRGTYECIATSSTGSERRVVMLTMEERVTSPRIEAASQKRTEVNFGDKLLLNCSATGEPKPQIMWRLPSKAVVDQQHRVGSWIHVYPNGSLFIGSVTEKDSGVYLCVARNKMGDDLILMHVSLRLKPAKIDHKQYFRKQVLHGKDFQVDCKASGSPVPEISWSLPDGTMINNAMQADDSGHRTRRYTLFNNGTLYFNKVGVAEEGDYTCYAQNTLGKDEMKVHLTVITAAPRIRQSNKTNKRIKAGDTAVLDCEVTGDPKPKIFWLLPSNDMISFSIDRYTFHANGSLTINKVKLLDSGEYVCVARNPSGDDTKMYKLDVVSKPPLINGLYTNRTVIKATAVRHSKKHFDCRAEGTPSPEVMWIMPDNIFLTAPYYGSRITVHKNGTLEIRNVRLSDSADFICVARNEGGESVLVVQLEVLEMLRRPTFRNPFNEKIVAQLGKSTALNCSVDGNPPPEIIWILPNGTRFSNGPQSYQYLIASNGSFIISKTTREDAGKYRCAARNKVGYIEKLVILEIGQKPVILTYAPGTVKGISGESLSLHCVSDGIPKPNIKWTMPSGYVVDRPQINGKYILHDNGTLVIKEATAYDRGNYICKAQNSVGHTLITVPVMIVAYPPRITNRPPRSIVTRTGAAFQLHCVALGVPKPEITWEMPDHSLLSTASKERTHGSEQLHLQGTLVIQNPQTSDSGIYKCTAKNPLGSDYAATYIQVI

SEQ ID NO: 1102 - protein, 536 aa, Homo sapiens
METMASPGKDNYRMKSYKNNALNPEEMRRRREEEGIQLRKQKREQQLFKRRNVELINEEAAMFDSLLMDSYVSSTTGESVITREMVEMLFSDDSDLQLATTQKFRKLLSKEPSPPIDEVINTPRVVDRFVEFLKRNENCTLQFEAAWALTNIASGTSQQTKIVIEAGAVPIFIELLNSDFEDVQEQAVWALGNIAGDSSVCRDYVLNCSILNPLLTLLTKSTRLTMTRNAVWALSNLCRGKNPPPEFAKVSPCLPVLSRLLFSSDSDLLADACWALSYLSDGPNEKIQAVIDSGVCRRLVELLMHNDYKVASPALRAVGNIVTGDDIQTQVILNCSALPCLLHLLSSPKESIRKEACWTISNITAGNRAQIQAVIDANIFPVLIEILQKAEFRTRKEAAWAITNATSGGTPEQIRYLVSLGCIKPLCDLLTVMDSKIVQVALNGLENILRLGEQEGKRSGSGVNPYCGLIEEAYGLDKIEFLQSHENQEIYQKAFDLIEHYFGVEDDDSSLAPQVDETQQQFIFQQPEAPMEGFQL

SEQ ID NO: 1103 - protein, 1801 aa, Homo sapiens
MPENPATDKLQVLQVLDRLKMKLQEKGDTSQNEKLSMFYETLKSPLFNQILTLQQSIKQLKGQLNHIPSDCSANFDFSRKGLLVFTDGSITNGNVHRPSNNSTVSGLFPWTPKLGNEDFNSVIQQMAQGRQIEYIDIERPSTGGLGFSVVALRSQNLGKVDIFVKDVQPGSVADRDQRLKENDQILAINHTPLDQNISHQQAIALLQQTTGSLRLIVAREPVHTKSSTSSSLNDTTLPETVCWGHVEEVELINDGSGLGFGIVGGKTSGVVVRTIVPGGLADRDGRLQTGDHILKIGGTNVQGMTSEQVAQVLRNCGNSVRMLVARDPAGDISVTPPAPAALPVALPTVASKGPGSDSSLFETYNVELVRKDGQSLGIRIVGYVGTSHTGEASGIYVKSIIPGSAAYHNGHIQVNDKIVAVDGVNIQGFANHDVVEVLRNAGQVVHLTLVRRKTSSSTSPLEPPSDRGTVVEPLKPPALFLTGAVETETNVDGEDEEIKERIDTLKNDNIQALEKLEKVPDSPENELKSRWENLLGPDYEVMVATLDTQIADDAELQKYSKLLPIHTLRLGVEVDSFDGHHYISSIVSGGPVDTLGLLQPEDELLEVNGMQLYGKSRREAVSFLKEVPPPFTLVCCRRLFDDEASVDEPRRTETSLPETEVDHNMDVNTEEDDDGELALWSPEVKIVELVKDCKGLGFSILDYQDPLDPTRSVIVIRSLVADGVAERSGGLLPGDRLVSVNEYCLDNTSLAEAVEILKAVPPGLVHLGICKPLVEDNEEESCYILHSSSNEDKTEFSGTIHDINSSLILEAPKGFRDEPYFKEELVDEPFLDLGKSFHSQQKEIEQSKEAWEMHEFLTPRLQEMDEEREMLVDEEYELYQDPSPSMELYPLSHIQEATPVPSVNELHFGTQWLHDNEPSESQEARTGRTVYSQEAQPYGYCPENVMKENFVMESLPSVPSTEGNSQQGRFDDLENLNSLAKTSLDLGMIPNDVQGPSLLIDLPVVAQRREQEDLPLYQHQATRVISKASAYTGMLSSRYATDTCELPEREEGEGEETPNFSHWGPPRIVEIFREPNVSLGISIVGGQTVIKRLKNGEELKGIFIKQVLEDSPAGKTNALKTGDKILEVSGVDLQNASHSEAVEAIKNAGNPVVFIVQSLSSTPRVIPNVHNKANKITGNQNQDTQEKKEKRQGTAPPPMKLPPPYKALTDDSDENEEEDAFTDQKIRQRYADLPGELHIIELEKDKNGLGLSLAGNKDRSRMSIFVVGINPEGPAAADGRMRIGDELLEINNQILYGRSHQNASAIIKTAPSKVKLVFIRNEDAVNQMAVTPFPVPSSSPSSIEDQSGTEPISSEEDGSVEVGIKQLPESESFKLAVSQMKQQKYPTKVSFSSQEIPLAPASSYHSTDADFTGYGGFQAPLSVDPATCPIVPGQEMIIEISKGRSGLGLSIVGGKDTPLNAIVIHEVYEEGAAARDGRLWAGDQILEVNGVDLRNSSHEEAITALRQTPQKVRLVVYRDEAHYRDEENLEIFPVDLQKKAGRGLGLSIVGKRNGSGVFISDIVKGGAADLDGRLIQGDQILSVNGEDMRNASQETVATILKCAQGLVQLEIGRLRAGSWTSARTTSQNSQGSQQSAHSSCHPSFAPVITGLQNLVGTKRVSDPSQKNSGTDMEPRTVEINRELSDALGISIAGGRGSPLGDIPVFIAMIQASGVAARTQKLKVGDRIVSINGQPLDGLSHADVVNLLKNAYGRIILQVVADTNISAIAAQLENMSTGYHLGSPTAEHHPEDTEEQLQMTAD

SEQ ID NO: 1104 - protein, 1153 aa, Homo sapiens
MACPWKFLFKTKFHQYAMNGEKDINNNVEKAPCATSSPVTQDDLQYHNLSKQQNESPQPLVETGKKSPESLVKLDATPLSSPRHVRIKNWGSGMTFQDTLHHKAKGILTCRSKSCLGSIMTPKSLTRGPRDKPTPPDELLPQAIEFVNQYYGSFKEAKIEEHLARVEAVTKEIETTGTYQLTGDELIFATKQAWRNAPRCIGRIQWSNLQVFDARSCSTAREMFEHICRHVRYSTNNGNIRSAITVFPQRSDGKHDFRVWNAQLIRYAGYQMPDGSIRGDPANVEFTQLCIDLGWKPKYGRFDVVPLVLQANGRDPELFEIPPDLVLEVAMEHPKYEWFRELELKWYALPAVANMLLEVGGLEFPGCPFNGWYMGTEIGVRDFCDVQRYNILEEVGRRMGLETHKLASLWKDQAVVEINIAVLHSFQKQNVTIMDHHSAAESFMKYMQNEYRSRGGCPADWIWLVPPMSGSITPVFHQEMLNYVLSPFYYYQVEAWKTHVWQDEKRRPKRREIPLKVLVKAVLFACMLMRKTMASRVRVTILFATETGKSEALAWDLGALFSCAFNPKVVCMDKYRLSCLEEERLLLVVTSTFGNGDCPGNGEKLKKSLFMLKELNNKFRYAVFGLGSSMYPRFCAFAHDIDQKLSHLGASQLTPMGEGDELSGQEDAFRSWAVQTFKAACETFDVRGKQHIQIPKLYTSNVTWDPHHYRLVQDSQPLDLSKALSSMHAKNVFTMRLKSRQNLQSPTSSRATILVELSCEDGQGLNYLPGEHLGVCPGNQPALVQGILERVVDGPTPHQTVRLEALDESGSYWVSDKRLPPCSLSQALTYFLDITTPPTQLLLQKLAQVATEEPERQRLEALCQPSEYSKWKFTNSPTFLEVLEEFPSLRVSAGFLLSQLPILKPRFYSISSSRDHTPTEIHLTVAVVTYHTRDGQGPLHHGVCSTWLNSLKPQDPVPCFVRNASGFHLPEDPSHPCILIGPGTGIAPFRSFWQQRLHDSQHKGVRGGRMTLVFGCRRPDEDHIYQEEMLEMAQKGVLHAVHTAYSRLPGKPKVYVQDILRQQLASEVLRVLHKEPGHLYVCGDVRMARDVAHTLKQLVAAKLKLNEEQVEDYFFQLKSQKRYHEDIFGAVFPYEAKKDRVAVQPSSLEMSAL

SEQ ID NO: 1105 - protein, 1087 aa, Homo sapiens; identical to SEQ ID NO: 896

SEQ ID NO: 1106 - protein, 946 aa, Homo sapiens
MAVYCYALNSLVIMNSANEMKSGGGPGPSGSETPPPPRRAVLSPGSVFSPGRGASFLFPPAESLSPEEPRSPGGWRSGRRRLNSSSGSGSGSSGSSVSSPSWAGRLRGDRQQVVAAGTLSPPGPEEAKRKLRILQRELQNVQVNQKVGMFEAHIQAQSSAIQAPRSPRLGRARSPSPCPFRSSSQPPGRVLVQGARSEERRTKSWGEQCPETSGTDSGRKGGPSLCSSQVKKGMPPLPGRAAPTGSEAQGPSAFVRMEKGIPASPRCGSPTAMEIDKRGSPTPGTRSCLAPSLGLFGASLTMATEVAARVTSTGPHRPQDLALTEPSGRARELEDLQPPEALVERQGQFLGSETSPAPERGGPRDGEPPGKMGKGYLPCGMPGSGEPEVGKRPEETTVSVQSAESSDSLSWSRLPRALASVGPEEARSGAPVGGGRWQLSDRVEGGSPTLGLLGGSPSAQPGTGNVEAGIPSGRMLEPLPCWDAAKDLKEPQCPPGDRVGVQPGNSRVWQGTMEKAGLAWTRGTGVQSEGTWESQRQDSDALPSPELLPQDPDKPFLRKACSPSNIPAVIITDMGTQEDGALEETQGSPRGNLPLRKLSSSSASSTGFSSSYEDSEEDISSDPERTLDPNSAFLHTLDQQKPRVSKSWRKIKNMVHWSPFVMSFKKKYPWIQLAGHAGSFKAAANGRILKKHCESEQRCLDRLMVDVLRPFVPAYHGDVVKDGERYNQMDDLLADFDSPCVMDCKMGIRTYLEEELTKARKKPSLRKDMYQKMIEVDPEAPTEEEKAQRAVTKPRYMQWRETISSTATLGFRIEGIKKEDGTVNRDFKKTKTREQVTEAFREFTKGNHNILIAYRDRLKAIRTTLEVSPFFKCHEVIGSSLLFIHDKKEQAKVWMIDFGKTTPLPEGQTLQHDVPWQEGNREDGYLSGLNNLVDILTEMSQDAPLA

SEQ ID NO: 1107 - protein, 977 aa, Homo sapiens
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKGNPDSHAYWIRPEDPFCDVPSSPCPSTMPSTACHPHLTTHCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 1108 - protein, 20 aa, Homo sapiens
SLGDVGNVTVAVPTVAAFPN

SEQ ID NO: 1109 - protein, 605 aa, Homo sapiens
MALRKGGLALALLLLSWVALGPRSLEGADPGTPGEAEGPACPAACVCSYDDDADELSVFCSSRNLTRLPDGVPGGTQALWLDGNNLSSVPPAAFQNLSSLGFLNLQGGQLGSLEPQALLGLENLCHLHLERNQLRSLALGTFAHTPALASLGLSNNRLSRLEDGLFEGLGSLWDLNLGWNSLAVLPDAAFRGLGSLRELVLAGNRLAYLQPALFSGLAELRELDLSRNALRAIKANVFVQLPRLQKLYLDRNLIAAVAPGAFLGLKALRWLDLSHNRVAGLLEDTFPGLLGLRVLRLSHNAIASLRPRTFKDLHFLEELQLGHNRIRQLAERSFEGLGQLEVLTLDHNQLQEVKAGAFLGLTNMAVMNLSGNCLRNLPEQVFRGLGKLHSLHLEGSCLGRIRPHTFTGLSGLRRLFLKDNGLVGIEEQSLWGLAELLELDLTSNQLTHLPHRLFQGLGKLEYLLLSRNRLAELPADALGPLQRAFWLDVSHNRLEALPNSLLAPLGRLRYLSLRNNSLRTFTPQPPGLERLWLEGNPWDCGCPLKALRDFALQNPSAVPRFVQAICEGDDCQPPAYTYNNITCASPPEVVGLDLRDLSEAHFAPC

SEQ ID NO: 1110 - protein, 1822 aa, Homo sapiens [sequence omitted]

SEQ ID NO: 1111 - protein, 342 aa, Homo sapiens; identical to SEQ ID NO: 906

SEQ ID NO: 1112 - protein, 72 aa, Homo sapiens
MALTFALLVALLVLSCKSSCSVGCDLPQTHSLGSRRTLMLLAQMRRISLFSCLKDRRDFGFPQEEFGNQFQK

SEQ ID NO: 1113 - protein, 478 aa, Homo sapiens
MSTNGDDHQVKDSLEQLRCHFTWELSIDDDEMPDLENRVLDQIEFLDTKYSVGIHNLLAYVKHLKGQNEEALKSLKEAENLMQEEHDNQANVRSLVTWGNFAWMYYHMGRLAEAQTYLDKVENICKKLSNPFRYRMECPEIDCEEGWALLKCGGKNYERAKACFEKVLEVDPENPESSAGYAISAYRLDGFKLATKNHKPFSLLPLRQAVRLNPDNGYIKVLLALKLQDEGQEAEGEKYIEEALANMSSQTYVFRYAAKFYRRKGSVDKALELLKKALQETPTSVLLHHQIGLCYKAQMIQIKEATKGQPRGQNREKLDKMIRSAIFHFESAVEKKPTFEVAHLDLARMYIEAGNHRKAEENFQKLLCMKPVVEETMQDIHFYYGRFQEFQKKSDVNAIIHYLKAIKIEQASLTRDKSINSLKKLVLRKLRRKALDLESLSLLGFVYKLEGNMNEALEYYERALRLAADFENSVRQGP

SEQ ID NO: 1114 - protein, 176 aa, Homo sapiens
MKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLCHAHMTCHCGEEAMKKYSQILSHFEKLEPQAAVVKALGELDILLQWMEETE

SEQ ID NO: 1115 - protein, 236 aa, Homo sapiens
MTRCPAGQAEVEMAELYVKPGNKERGWNDPPQFSYGLQTQAGGPRRSLLTKRVAAPQDGSPRVPASETSPGPPPMGPPPPSSKAPRSPPVGSGPASGVEPTSFPVESEAVMEDVLRPLEQALEDCRGHTRKQVCDDISRRLALLQEQWAGGKLSIPVKKRMALLVQELSSHRWDAADDIHRSLMVDHVTEVSQWMVGVKRLIAEKRSLFSEEAANEEKSAATAEKNHTIPGFQQAS

SEQ ID NO: 1116 - protein, 1696 aa, Homo sapiens
MAQFPTAMNGGPNMWAITSEERTKHDRQFDNLKPSGGYITGDQARNFFLQSGLPAPVLAEIWALSDLNKDGKMDQQEFSIAMKLIKLKLQGQQLPVVLPPIMKQPPMFSPLISARFGMGSMPNLSIPQPLPPAAPITSLSSATSGTNLPPLMMPTPLVPSVSTSSLPNGTASLIQPLPIPYSSSTLPHGSSYSLMMGGFGGASIQKAQSLIDLGSSSSTSSTASLSGNSPKTGTSEWAVPQPTRLKYRQKFNTLDKSMSGYLSGFQARNALLQSNLSQTQLATIWTLADVDGDGQLKAEEFILAMHLTDMAKAGQPLPLTLPPELVPPSFRGGKQIDSINGTLPSYQKMQEEEPQKKLPVTFEDKRKANYERGNMELEKRRQALMEQQQREAERKAQKEKEEWERKQRELQEQEWKKQLELEKRLEKQRELERQREEERRKDIERREAAKQELERQRRLEWERIRRQELLNQKNREQEEIVRLNSKKKNLHLELEALNGKHQQISGRLQDVRLKKQTQKTELEVLDKQCDLEIMEIKQLQQELQEYQNKLIYLVPEKQLLNERIKNMQFSNTPDSGVSLLHKKSLEKEELCQRLKEQLDALEKETASKLSEMDSFNNQLKCGNMDDSVLQCLLSLLSCLNNLFLLLKELRETYNTQQLALEQLYKIKRDKLKEIERKRLELMQKKKLEDEAARKAKQGKENLWKENLRKEEEEKQKRLQEEKTQEKIQEEERKAEEKQRKDKDTLKAEEKKRETASVLVNYRALYPFEARNHDEMSFNSGDIIQVDEKTVGEPGWLYGSFQGNFGWFPCNYVEKMPSSENEKAVSPKKALLPPTVSLSATSTSSEPLSSNQPASVTDYQNVSFSNLTVNTSWQKKSAFTRTVSPGSVSPIHGQGQVVENLKAQALCSWTAKKDNHLNFSKHDIITVLEQQENWWFGEVHGGRGWFPKSYVKIIPGSEVKREEPEALYAAVNKKPTSAAYSVGEEYIALYPYSSVEPGDLTFTEGEEILVTQKDGEWWTGSIGDRSGIFPSNYVKPKDQESFGSASKSGASNKKPEIAQVTSAYVASGSEQLSLAPGQLILILKKNTSGWWQGELQARGKKRQKGWFPASHVKLLGPSSERATPAFHPVCQVIAMYDYAANNEDELSFSKGQLINVMNKDDPDWWQGEINGVTGLFPSNYVKMTTDSDPSQQWCADLQTLDTMQPIERKRQGYIHELIQTEERYMADLQLVVEVFQKRMAESGFLTEGEMALIFVNWKELIMSNTKLLKALRVRKKTGGEKMPVQMIGDILAAELSHMQAYIRFCSCQLNGAALLQQKTDEDTDFKEFLKKLASDPRCKGMPLSSFLLKPMQRITRYPLLIRSILENTPESHADHSSLKLALERAEELCSQVNEGVREKENSDRLEWIQAHVQCEGLAEQLIFNSLTNCLGPRKLLHSGKLYKTKSNKELHGFLFNDFLLLTYMVKQFAVSSGSEKLFSSKSNAQFKMYKTPIFLNEVLVKLPTDPSSDEPVFHISHIDRVYTLRTDNINERTAWVQKIKAASEQYIDTEKKKREKAYQARSQKTSGIGRLMVHVIEATELKACKPNGKSNPYCEISMGSQSYTTRTIQDTLNPKWNFNCQFFIKDLYQDVLCLTLFDRDQFSPDDFLGRTEIPVAKIRTEQESKGPMTRRLLLHEVPTGEVWVRFDLQLFEQKTLL

SEQ ID NO: 1117 - protein, 1313 aa, Homo sapiens
MSGWRYLICVSFLLTILLELTYQGPPVPASSSTKLLMTSYSMRSTVVSRYAHTLVTSVLFNPHAEAHEAIFDLDLPHLAFISNFTMTINNKVYIAEVKEKHQAKKIYEEAHQQGKTAAHVGIRDRESEKFRISTSLAAGTEVTFSLAYEELLQRHQGQYQLVVSLRPGQLVKRLSIEVTVSERTGISYVHIPPLRTGRLRTNAHASEVDSPPSTRIERGETCVRITYCPTLQDQSSISGSGIMADFLVQYDVVMEDIIGDVQIYDDYFIHYFAPRGLPPMEKNVVFVIDVSSSMFGTKMEQTKTAMNVILSDLQANDYFNIISFSDTVNVWKAGGSIQATIQNVHSAKDYLHCMEADGWTDVNSALLAAASVLNHSNQEPGRGPSVGRIPLIIFLTDGEPTAGVTTPSVILSNVRQALGHRVSLFSLAFGDDADFTLLRRLSLENRGIARRIYEDTDAALQLKGLYEEISMPLLADVRLNYLGGLVGASPWAVFPNYFGGSELVVAGQVQPGKQELGIHLAARGPKDQLLVAHHSEGATNNSQKAFGCPGEPAPNVAHFIRRLWAYVTIGELLDAHFQARDTTTRHLLAAKVLNLSLEYNFVTPLTSLVMVQPKQASEETRRQTSTSAGPDTIMPSSSSRHGLGVSTAQPALVPKVISPKSRPVKPKFYLSSTTTASTKKMLSSKELEPLGESPHTLSMPTYPKAKIPAQQDSGTLAQPTLRTKPTILVPSNSGTLLPLKPGSLSHQNPDILPTNSRTQVPPVKPGIPASPKADTVKCVTPLHSKPGAPSHPQLGALTSQAPKGLPQSRPGVSTLQVPKYPLHTRPRVPAPKTRNNMPHLGPGILLSKTPKILLSLKPSAPPHQISTSISLSKPETPNPHMPQTPLPPRPDRPRPPLPESLSTFPNTISSSTGPSSTTTTSVLGEPLPMPFTPTLPPGRFWHQYDLLPGPQRTRQVLGPSRPGVPTMSLLNSSRPTPEGSPPNLPILLPSSILPEAISLLLLPEELELLSESMVESKFVESLNPPAFYTFLTPDEDGSPNWDGNSEEILGGAGGSMESQGSSVGLAKGTLPSIFTFSSSVDGDPHFVIQIPHSEEKICFTLNGHPGDLLQLIEDPKAGLHVSGKLLGAPPRPGHKDQTRTYFQIITVTTDKPRAYTITISRSSISLRGEGTLRLSWDQPALLKRPQLELYVAAAARLTLRLGPYLEFLVLRHRYRHPSTLQLPHLGFYVANGSGLSPSARGLIGQFQHADIRLVTGPMGPCLRRHHGPDVPVILGKRLLKDSPRLLPRWASCWLVKRSHVELLLGHPYLSYVL

SEQ ID NO: 1118 - protein, 357 aa, Homo sapiens; identical to SEQ ID NO: 962

SEQ ID NO: 1119 - protein, 620 aa, Homo sapiens
MASDSMSSKQARNHITKGKRQQQHQQIKNRSSISDGDGEDSFIFEANEAWKDFHGSLLRFYENGELCDVTLKVGSKLISCHKLVLACVIPYFRAMFLSEMAEAKQTLIEIRDFDGDAIEDLVKFVYSSRLTLTVDNVQPLLYAACILQVELVARACCEYMKLHFHPSNCLAVRAFAESHNRIDLMDMADQYACDHFTEVVECEDFVSVSPQHLHKLLSSSDLNIENEKQVYNAAIKWLLANPQHHSKWLDETLAQVRLPLLPVDFLMGVVAKEQIVKQNLKCRDLLDEARNYHLHLSSRAVPDFEYSIRTTPRKHTAGVLFCVGGRGGSGDPFRSIECYSINKNSWFFGPEMNSRRRHVGVISVEGKVYAVGGHDGNEHLGSMEMFDPLTNKWMMKASMNTKRRGIALASLGGPIYAIGGLDDNTCFNDVERYDIESDQWSTVAPMNTPRGGVGSVALVNHVYAVGGNDGMASLSSVERYDPHLDKWIEVKEMGQRRAGNGVSKLHGCLYVVGGFDDNSRLSSVERYDPRSNKWDYVAALTTPRGGVGIATVMGKIFAVGGHNGNAYLNTVEAFDPVLNRWELVGSVSHCRAGAGVAVCSCLTSQIRDVGHGSNNVVDCM

SEQ ID NO: 1120 - protein, 643 aa, Homo sapiens
SRQFSSRSGYRSGGGFSSGSAGIINYQRRTTSSSTRRSGGGGGRFSSCGGGGGSFGAGGGFGSRSLVNLGGSKSISISVARGGGRGSGFGGGYGGGGFGGGGFGGGGFGGGGIGGGGFGGFGSGGGGFGGGGFGGGGYGGGYGPVCPPGGIQEVTINQSLLQPLNVEIDPEIQKVKSREREQIKSLNNQFASFIDKVRFLEQQNQVLQTKWELLQQVDTSTRTHNLEPYFESFINNLRRRVDQLKSDQSRLDSELKNMQDMVEDYRNKYEDEINKRTNAENEFVTIKKDVDGAYMTKVDLQAKLDNLQQEIDFLTALYQAELSQMQTQISETNVILSMDNNRSLDLDSIIAEVKAQNEDIAQKSKAEAESLYQSKYEELQITAGRHGDSVRNSKIEISELNRVIQRLRSEIDNVKKQISNLQQSISDAEQRGENALKDAKNKLNDLEDALQQAKEDLARLLRDYQELMNTKLALDLEIATYRTLLEGEESRMSGECAPNVSVSVSTSHTTISGGGSRGGGGGGYGSGGSSYGSGGGSYGSGGGGGGGRGSYGSGGSSYGSGGGSYGSGGGGGGHGSYGSGSSSGGYRGGSGGGGGGSSGGRGSGGGSSGGSIGGRGSSSGGVKSSGGSSSVRFVSTTYSGVTR

SEQ ID NO: 1121 - protein, 819 aa, Homo sapiens
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPAPAPPLYSSLT

SEQ ID NO: 1122 - protein, 966 aa, Homo sapiens
MEPQVTLNVTFKNEIQSFLVSDPENTTWADIEAMVKVSFDLNTIQIKYLDEENEEVSINSQGEYEEALKMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQPIISEDQTAALMARLFEMGFCDRQLNLRLLKKHNYNILQVVTELLQLNNNDWYSQRY

SEQ ID NO: 1123 - protein, 1042 aa, Homo sapiens
MADAFGDELFSVFEGDSTTAAGTKKDKEKDKGKWKGPPGSADKAGKRFDGKLQSESTNNGKNKRDVDFEGTDEPIFGKKPRIEESITEDLSLADLMPRVKVQSVETVEGCTHEVALPAEEDYLPLKPRVGKAAKEYPFILDAFQREAIQCVDNNQSVLVSAHTSAGKTVCAEYAIALALREKQRVIFTSPIKALSNQKYREMYEEFQDVGLMTGDVTINPTASCLVMTTEILRSMLYRGSEVMREVAWVIFDEIHYMRDSERGVVWEETIILLPDNVHYVFLSATIPNARQFAEWICHLHKQPCHVIYTDYRPTPLQHYIFPAGGDGLHLVVDENGDFREDNFNTAMQVLRDAGDLAKGDQKGRKGGTKGPSNVFKIVKMIMERNFQPVIIFSFSKKDCEAYALQMTKLDFNTDEEKKMVEEVFSNAIDCLSDEDKKLPQVEHVLPLLKRGIGIHHGGLLPILKETIEILFSEGLIKALFATETFAMGINMPARTVLFTNARKFDGKDFRWISSGEYIQMSGRAGRRGMDDRGIVILMVDEKMSPTIGKQLLKGSADPLNSAFHLTYNMVLNLLRVEEINPEYMLEKSFYQFQHYRAIPGVVEKVKNSEEQYNKIVIPNEESVVIYYKIRQQLAKLGKEIEEYIHKPKYCLPFLQPGRLVKVKNEGDDFGWGVVVNFSKKSNVKPNSGELDPLYVVEVLLRCSKESLKNSATEAAKPAKPDGKGEMQVVPVLVHLLSAISSVRLYIPKDLRPVDNRQSVLKSIQEVQKRFPDGIPLLDPIDDMGIQDQGLKKVIQKVEAFEHRMYSHPLHNDPNLETVYTLCEKKAQIAIDIKSAKRELKKARTVLQMDELKCRKRVLRRLGFATSSDVIEMKGRVACEISSADELLLTEMMFNGLFNDLSAEQATALLSCFVFQENSSEMPKLTERLAGPLRQMQECAKRIAKVSAEAKLEIDEETYLSSFKPHLMDVVYTWATGATFAHICKMTDVFEGSIIRCMRRLEELLRQMCQAAKAIGNTELENKFAEGITKIKRDIVFAASLYL

SEQ ID NO: 1124 - protein, 2235 aa, Homo sapiens
MPLFFSALLVLLLVALSALFLGRWLVVRLATKWCQRKLQAELKIGSFRFFWIQNVSLKFQQHQQTVEIDNLWISSKLLSHDLPHYVALCFGEVRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKVVLRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 1125 - protein, 1227 aa, Homo sapiens
MGDTSEDASIHRLEGTDLDCQVGGLICKSKSAASEQHVFKAPAPRPSLLGLDLLASLKRREREEKDDGEDKKKSKVSSYKDWEESKDDQKDAEEEGGDQAGQNIRKDRHYRSARVETPSHPGGVSEEFWERSRQRERERREHGVYASSKEEKDWKKEKSRDRDYDRKRDRDERDRSRHSSRSERDGGSERSSRRNEPESPRHRPKDAATPSRSTWEEEDSGYGSSRRSQWESPSPTPSYRDSERSHRLSTRDRDRSVRGKYSDDTPLPTPSYKYNEWADDRRHLGSTPRLSRGRGRREEGEEGISFDTEEERQQWEDDQRQADRDWYMMDEGYDEFHNPLAYSSEDYVRRREQHLHKQKQKRISAQRRQINEDNERWETNRMLTSGVVHRLEVDEDFEEDNAAKVHLMVHNLVPPFLDGRIVFTKQPEPVIPVKDATSDLAIIARKGSQTVRKHREQKERKKAQHKHWELAGTKLGDIMGVKKEEEPDKAVTEDGKVDYRTEQKFADHMKRKSEASSEFAKKKSILEQRQYLPIFAVQQELLTIIRDNSIVIVVGETGSGKTTQLTQYLHEDGYTDYGMIGCTQPRRVAAMSVAKRVSEEMGGNLGEEVGYAIRFEDCTSENTLIKYMTDGILLRESLREADLDHYSAIIMDEAHERSLNTDVLFGLLREVVARRSDLKLIVTSATMDAEKFAAFFGNVPIFHIPGRTFPVDILFSKTPQEDYVEAAVKQSLQVHLSGAPGDILIFMPGQEDIEVTSDQIVEHLEELENAPALAVLPIYSQLPSDLQAKIFQKAPDGVRKCIVATNIAETSLTVDGIMFVIDSGYCKLKVFNPRIGMDALQIYPISQANANQRSGRAGRTGPGQCFRLYTQSAYKNELLTTTVPEIQRTNLANVVLLLKSLGVQDLLQFHFMDPPPEDNMLNSMYQLWILGALDNTGGLTSTGRLMVEFPLDPALSKMLIVSCDMGCSSEILLIVSMLSVPAIFYRPKGREEESDQIREKFAVPESDHLTYLNVYLQWKNNNYSTIWCNDHFIHAKAMRKVREVRAQLKDIMVQQRMSLASCGTDWDIVRKCICAAYFHQAAKLKGIGEYVNIRTGMPCHLHPTSSLFGMGYTPDYIVYHELVMTTKEYMQCVTAVDGEWLAELGPMFYSVKQAGKSRQENRRRAKEEASAMEEEMALAEEQLRARRQEQEKRSPLGSVRSTKIYTPGRKEQGEPMTPRRTPARFGL

SEQ ID NO: 1126 - protein, 595 aa, Homo sapiens
LGLPFPCLCRVPCNTVFGSQHQMDVAFLEKLIKDDIERGRLPLLLVANAGTAAVGHTDKIGRLKELCEQYGIWLHVEGVNLATLALGYVSSSVLAAAKCDSMTMTPGPWLGLPAVPAVTLYKHDDPALTLVAGLTSNKPTDKLRALPLWLSLQYLGLDGFVERIKHACQLSQRLQESLKKVNYIKILVEDELSSPVVVFRFFQELPGSDPVFKAVPVPNMTPSGVGRERHSCDALNRWLGEQLKQLVPASGLTVMDLEAEGTCLRFSPLMTAAVLGTRGEDVDQLVACIESKLPVLCCTLQLREEFKQEVEATAGLLYVDDPNWSGIGVVRYEHANDDKSSLKSDPEGENIHAGLLKKLNELESDLTFKIGPEYKSMKSCLYVGMASDNVDAAELVETIAATAREIEENSRLLENMTEVVRKGIQEAQVELQKASEERLLEEGVLRQIPVVGSVLNWFSPVQALQKGRTFNLTAGSLESTEPIYVYKAQGAGVTLPPTPSGSRTKQRLPGQKPFKRSLRGSDALSETSSVSHIEDLEKVERLSSGPEQITLEASSTEGHPGAPSPQHTDQTEAFQKGVPHPEDDHSQVEGPESLR

SEQ ID NO: 1127 - protein, 2467 aa, Homo sapiens
GLQESQERPVVTCLKHEDFELAFLLLTKGADPRAISLTEGDTPLHAALHIFLEIKADIGFSFLSHLLDLFWSNPTEFDYLNPNVQDSNGNTLMHILFQKGMLKRVKKLLDLLVKFDINFNLKNKEGKDARHRIKKNDSLLLAWNKALMENRRRSRQDSAAHLGKLSKSTAPGHTSQLKSQGSFKSVPCGATARTLPEGSAVPDSWETLPGTQVTRKEPGALRPCSLRDCLMQDITVLIQQVEVDPSFPEDCLQSSEPLEAGAGKEGKKDDKPTLGAGAPDCSEVGEGHAQVGLGALQLVPDDNRGKEGNDDQDDWSTQEIEACLQDFDNMTWEIECTSEMLKKLSSKVMTKVIKKKIILAIQQLGNGEWTQGLQKRLKHLKGSIQLFEAKLDKGARMLWELAIDFSPRCSENPEKIIATEQNTCAMEKSGRIYTEIIRIWDIVLDHCKLADSIKAICNAYNRGLSCVLRKKLKGINKGQVSANMKIQKRIPRCYVEDTEAEKGREHVNPEYFPPASAVETEYNIMKFHSFSTNMAFNILNDTTATVEYPFRVGELEYAVIDLNPRPLEPIILIGRSGTGKTTCCLYRLWKKFHVYWEKAEQAGSPLLAKQVWLKRRLEVEPGKESPGGEEEGEEEDEEEEDSIEVETVESIDEQEYEACAGGAGVEPAGDGQAAEVCAPEHPHQLEHLHQIFVTKNHVLCQEVQRNFIELSKSTKATSHYKPLDPNIHKLQDLRDENFPLFVTSKQLLLLLDASLPKPFFLRNEDGSLKRTIIGWSAQEESTIPSWQEDEEEAEVDGDYSEEDKAVEMRTGDSDPRVYVTFEVFKNEIWPKMTKGRTAYNPALIWKEIKSFLKGSFEALSCPHGRLTEEVYKKLGRKRCPNFKEDRSEIYSLFSLYQQIRSQKGYFDEEDVLYNISRRLSKLRVLPWSIHELYGDEIQDFTQAELALLMKCINDPNSMFLTGDTAQSIMKGVAFRFSDLRSLFHYASRNTIDKQCAVRKPKKIHQLYQNYRSHSGILNLASGVVDLLQFYFPESFDRLPRDSGLFDGPKPTVLESCSVSDLAILLRGNKRKTQPIEFGAHQVILVANETAKEKIPEELGLALVLTIYEAKGLEFDDVLLYNFFTDSEAYKEWKIISSFTPTSTDSREENRPLVEVPLDKPGSSQGRSLMVNPEMYKLLNGELKQLYTAITRARVNLWIFDENREKRAPAFKYFIRRDFVQVVKTDENKDFDDSMFVKTSTPAEWIAQGDYYAKHQCWKVAAKCYQKGGAFEKEKLALAHDTALSMKSKKVSPKEKQLEYLELAKTYLECKEPTLSLKCLSYAKEFQLSAQLCERLGKIRDAAYFYKRSQCYKDAFRCFEQIQEFDLALKMYCQEELFEEAAIAVEKYEEMLKTKTLPISKLSYSASQFYLEAAAKYLSANKMKEMMAVLSKLDIEDQLVFLKSRKRLAEAADLLNREGRREEAALLMKQHGCLLEAARLTADKDFQASCLLGAARLNVARDSDIEHTKDILREALDICYQTGQLSGIAEAHFLQGVILRDFQKLRDAFFKFDTLNHSAGVVEALYEAASQCEAEPEKILGLAPGGLEILLSLVRALKRVTNNAEKEMVKSCFEFFGISQVDAKYCQIAQNDPGPILRIIFDLDLNLREKKTKDHFLIMTDQVKLALNKHLLGRLCQITRSLLGKTYRGVCMRFIVGLKCEDENCEHFHRPLRRCEAKCLVQSKMNLVAINGLLLEAKKVFPKILAEELKEIDYILSTDMYGLCKSILDVLFPKHFHQRVLSENPMACKEILKPNYKSFRFYRFALKEYIHFLFENESARNRRESTDLWLSAMQAFLLSSNYPEEFEKLLHQEEDNYNRELKALESEKDERGRGRGSRIKGIEGKFGMLAPNRDDENMDKTHLCFIRLLENCIDQFYVYRNPEDYKRLFFRFMNVLIKRCKEPLIPSIGNTVALLEFQFIHCGVVLARLWKNVILCLPKSYIALLHYWEFLFSKKDKELGDVFSIIQEYKPKDVTRAIQDFRFHLSYLAKVLCGYENVNFNVLLDAFSEIDYVVSGEAERTLVLCLVMLVNAEEILQPYCKPLLYRHFREIESRLQLMSMDCPGQVPERLLKVVKRVLVAVNVKSVAEALQDLLFERDEEYLMDCDWRWDPVHTKGSIVRGLYYEEVRLNRLLCLDPVDYFAEPECEFGQDEMDELALEDRDHVLATILSQKQRKASIQRKLRRACLVVSLCISWRRRVGTQMERVREEAREPRAGNFKKADVDRTQCDLCGVKFTRGPENYFSPSKAFEGAASEVAVLSRAELEREECQERNSESYEQHIHLEHHQRQQVAYQKYSEFFHEKVDPAIDEGKLVVQDIEQSVWIHSHVGSKEHSHMLQKVQEHIKRVSDMVEDLYRRKAWAGAEEAMTRLVNILILSVRDARDWLMKTETRLKKEGIVQEDDYENEVEDFGELRPRRRSRKCGKQRKY

SEQ ID NO: 1128 - protein, 2992 aa, Homo sapiens
EVRGIVDKAAKEMGMEKTLKELQTTWAGMEFQYEPHPRTNVPLLCSDEDLIEVLEDNQVQLQNLVMSKYVAFFLEEVSGWQKKLSTVDAVISIWFEVQRTWTHLESIFTGSEDIRAQLPQDSKRFEGIDIDFKELAYDAQKIPNVVQTTNKPGLYEKLEDIQGRLCLCEKALAEYLDTKRLAFPRFYFLSSSDLLDILSNGTAPQQVQRHLSKLFDNMAKMRFQLDASGEPTKTSLGMYSKEEEYVAFSEPCDCSGQVEIWLNHVLGHMKATVRHEMTEGVTAYEEKPREQWLFDHPAQVALTCTQIWWTTEVGMAFARLEEGYESAMKDYYKKQVAQLKTLITMLIGQLSKGDRQKIMTICTIDVHARDVVAKMIAQKVDNAQAFLWLSQLRHRWDDEVKHCFANICDAQFLYSYEYLGNTPRLVITPLTDRCYITLTQSLHLTMSGAPAGPAGTGKTETTKDLGRALGILVYVFNCSEQMDYKSCGNIYKGLAQTGAWGCFDEFNRISVEVLSVVAVQVKSIQDAIRDKKQWFSFLGEEISLNPSVGIFITMNPGYAGRTELPENLKSLFRPCAMVVPDFELICEIMLVAEGFIEAQSLARKFITLYQLCKELLSKQDHYDWGLRAIKSVLVVAGSLKRGDPDRPEDQVLMRSLRDFNIPKIVTDDMPIFMGLIGDLFPALDVPRRRDPNFEALVRKAIVDLKLQAEDNFVLKVVQLEELLAVRHSVFVVGGAGTGKSQVLRSLHKTYQIMKRRPVWTDLNPKAVTNDELFGIINPATGEWKDGLFSSIMRELANTTHDGPKWILLDGDIDPMWIESLNTVMDDNKVLTLASNERIPLNPTMKLLFEISHLRTATPATVSRAGILYINPADLGWNPPVSSWIEKREIQTERANLTILFDKYLPTCLDTLRTRFKKIIPIPEQSMVQMVCHLLECLLTTEDIPADCPKEIYEHYFVFAAIWAFGGAMVQDQLVDYRAEFSKWWLTEFKTVKFPSQGTIFDYYIDPETKKFEPWSKLVPQFEFDPEMPLQACLVHTSETIRVCYFMERLMARQRPVMLVGTAGTGKSVLVGAKLASLDPEAYLVKNVPFNYYTTSAMLQAVLEKPLEKKAGRNYGPPGNKKLIYFIDDMNMPEVDAYGTVQPHTIIRQHLDYGHWYDRSKLSLKEITNVQYVSCMNPTAGSFTINPRLQRHFSVFVLSFPGADALSSIYSIILTQHLKLGNFPASLQKSIPPLIDLALAFHQKIATTFLPTGIKFHYIFNLRDFANIFQGILFSSVECVKSTWDLIRLYLHESNRVYRDKMVEEKDFDLFDKIQTEVLKKTFDDIEDPVEQTQSPNLYCHFANGIGEPKYMPVQSWELLTQTLVEALENHNEVNTVMDLVLFEDAMRHVCHINRILESPRGNALLVGVGGSGKQSLTRLAAFISSMDVFQITLRKGYQIQDFKMDLASLCLKAGVKNLNTVFLMTDAQVADERFLVLINDLLASGEIPDLYSDDEVENIISNVRNEVKSQGLVDNRENCWKFFIDRIRRQLKVTLCFSPVGNKLRVRSRKFPAIVNCTAIHWFHEWPQQALESVSLRFLQNTEGIEPTVKQSISKFMAFVHTSVNQTSQSYLSNEQRYNYTTPKSFLEFIRLYQSLLHRHRKELKCKTERLENGLLKLHSTSAQVDDLKAKLAAQEVELKQKNEDADKLIQVVGVETDKVSREKAMADEEEQKVAVIMLEVKQKQKDCEEDLAKAEPALTAAQAALNTLNKTNLTELKSFGSPPLAVSNVSAAVMVLMAPRGRVPKDRSWKAAKVTMAKVDGFLDSLINFNKENIHENCLKAIRPYLQDPEFNPEFVATKSYAAAGLCSWVINIVRFYEVFCDVEPKRQALNKATADLTAAQEKLAAIKAKIAHLNENLAKLTARFEKATADKLKCQQEAEVTAVTISLANRLVGGLASENVRWADAVQNFKQQERTLCGDILLITAFISYLGFFTKKYRQSLLDRTWRPYLSQLKTPIPVTPALDPLRMLMDDADVAAWQNEGLPADRMSVENATILINCERWPLMVDPQLQGIKWIKNKYGEDLRVTQIGQKGYLQIIEQALEAGAVVLIENLEESIDPVLGPLLGREVIKKGRFIKIGDKECEYNPKFRLILHTKLANPHYQPELQAQATLINFTVTRDGLEDQLLAAVVSMERPDLEQLKSDLTKQQNGFKITLKTLEDSLLSRLSSASGNFLGETVLVENLEITKQTAAEVEKKVQEAKVTEVKINEAREHYRPAAARASLLYFIMNDLSKIHPMYQFSLKAFSIVFQKAVERAAPDESLRERVANLIDSITFSVYQYTIRGLFECDKLTYLAQLTFQILLMNREVNAVELDFLLRSPVQTGTASPVEFLSHQAWGAVKVLSSMEEFSNLDRDIEGSAKSWKKFVESECPEKEKLPQEWKNKTALQRLCMLRAMRPDRMTYALRDFVEEKLGSKYVVGRALDFATSFEESGPATPMFFILSPGVDPLKDVESQGRKLGYTFNNQNFHNVSLGQGQEVVAEAALDLAAKKGHWVILQNTLEMCSRETEFKSILFALCYFHAVVAERRKFGPQGWNRSYPFNTGDLTISVNVLYNFLEANAKVPYDDLRYLFGEIMYGGHITDDWDRRLCRTYLGEFIRPEMLEGELSLAPGFPLPGNMDYNGYHQYIDAELPPESPYLYGLHPNAEIGFLTQTSEKLFRTVLELQPRDSQARDGAGATREEKVKALLEEILERVTDEFNIPELMAKVEERTPYIVVAFQECGRMNILTREIQRSLRELELGLKGELTMTSHMENLQNALYFDMVPESWARRAYPSTAGLAAWFPDLLNRIKELEAWTGDFTMPSTVWLTGFFNPQSFLTAIMQSTARKNEWPLDQMALQCDMTKKNREEFRSPPREGAYIHGLFMEGACWDTQAGIITEAKLKDLTPPMPVMFIKAIPADKQDCRSVYSCPVYKTSQRGPTYVWTFNLKTKENPSKWVLAGVALLLQI

SEQ ID NO: 1129 - protein, 1564 aa, Homo sapiens
MSSKEVKTALKSARDAIRNKEYKEALKHCKTVLKQEKNNYNAWVFIGVAAAELEQPDQAQSAYKKAAELEPDQLLAWQGLANLYEKYNHINAKDDLPGVYQKLLDLYESVDKQKWCDVCKKLVDLYYQEKKHLEVARTWHKLIKTRQEQGAENEELHQLWRKLTQFLAESTEDQNNETQQLLFTAFENALGLSDKIPSEDHQVLYRHFIQSLSKFPHESARLKKACEGMINIYPTVQYPLEVLCLHLIESGNLTDEGQQYCCRLVEMDSKSGPGLIGLGIKALQDKKYEDAVRNLTEGLKESPVCTSGWYHLAEAQVKMHRPKEAVLSCSQALKIVDNLGASGNSLYQRNLCLHLKAEALIKLSDYDSSEEAIRTLDQISDADNIPGLLVLKSLAYRNKGSFDEAAKIMEDLLSSYPDLAEVHALEALIHFTKKDYLQAEKCFQRALEKDTEVAEYHYQLGLTYWFMGEETRKDKTKALTHFLKAARLDTYMGKVFCYLGHYYRDVVGDKNRARGCYRKAFELDDTDAESGAAAVDLSVELEDMEMALAILTTVTQKASAGTAKWAWLRRGLYYLKAGQHSQAVADLQAALRADPKDFNCWESLGEAYLSRGGYTTALKSFTKASELNPESIYSVFKVAAIQQILGKYKEAVAQYQMIIKKKEDYVPALKGLGECHLMMAKAALVDYLDGKAVDYIEKALEYFTCALQHRADVSCLWKLAGDACTCLYAVAPSKVNVHVLGVLLGQKEGKQVLKKNELLHLGGRCYGRALKLMSTSNTWCDLGINYYRQAQHLAETGSNMNDLKELLEKSLHCLKKAVRLDSNNHLYWNALGVVACYSGIGNYALAQHCFIKSIQSEQINAVAWTNLGVLYLTNENIEQAHEAFKMAQSLDPSYLMCWIGQALIAEAVGSYDTMDLFRHTTELNMHTEGALGYAYWVCTTLQDKSNRETELYQYNILQMNAIPAAQVILNKYVERIQNYAPAFTMLGYLNEHLQLKKEAANAYQRAILLLQTAEDQDTYNVAIRNYGRLLCSTGEYDKAIQAFKSTPLEVLEDIIGFALALFMKGLYKESSKAYERALSIVESEQDKAHILTALAITEYKQGKTDVAKTLLFKCSILKEPTTESLQALCALGLAMQDATLSKAALNELLKHIKHKDSNYQRCLLTSAIYALQGRSVAVQKQISKAVHSNPGDPALWSLLSRVVAQYAQRNAKGGVVAGNVAHILDSNHGKKALLYTAVNQLAMGSSSAEDEKNTALKTIQKAALLSPGDPAIWAGLMAACHADDKLALVNNTQPKRIDLYLALLSAVSASIKDEKFFENYNQSLEKWSLSQAVTGLIDTGRISEAETLCTKNLKSNPDQPAVILLLRQVQCKPLLESQKPLPDAVLEELQKTVMSNSTSVPAWQWLAHVYQSQGMMRAAEMCYRKSLQLASQRGSWSGKLSSLLRLALLALKVCMANISNDHWPSLVQEATTEALKLCFCPLAVLLQALLQFKRKMGARETRRLLERVVYQPGYPKSIASTARWYLLRHLYAKDDYELIDVLVNNAKTHGDTRALELNQRLSSQ

SEQ ID NO: 1130 - protein, 1408 aa, Homo sapiens [sequence omitted]

SEQ ID NO: 1131 - protein, 1085 aa, Homo sapiens
HDKEPSSLGLPTRLPEIMLVGSQSFSPGGPNGIIRSQSFAGFSGLQERRSRCNSFIENSSALKKPQAKLKKMHNLGHKNNNPPKEPQPKRVEEVYRALKNGLDEYLEVHQTELDKLTAQLKDMKRNSRLGVLYDLDKQIKTIERYMRRLEFHISKVDELYEAYCIQRRLQDGASKMKQAFATSPASKAARESLTEINRSFKEYTENMCTIEVELENLLGEFSIKMKGLAGFARLCPGDQYEIFMKYGRQRWKLKGKIEVNGKQSWDGEETVFLPLIVGFISIKVTELKGLATHILVGSVTCETKELFAARPQVVAVDINDLGTIKLNLEITWYPFDMEDMTASSGAGNKAAALQRRMSMYSQGTPETPTFKDHSFFRWLHPSPDKPRRLSVLSALQDTFFAKLHRSRSFSDLPSLRPSPKAVLELYSNLPDDIFENGKAAEEKMPLSLSFSDLPNGDCALTSHSTGSPSNSTNPEITITPAEFNLSSLASQNEGMDDTSSASSRNSLGEGQEPKSHLKEEDPEEPRKPASAPSEACRRQSSGAGAEHLFLENDVAEALLQESEEASELKPVELDTSEGNITKQLVKRLTSAEVPMATDRLLSEGSVGGESEGCRSFLDGSLEDAFNGLLLALEPHKEQYKEFQDLNQEVMNLDDILKCKPAVSRSRSSSLSLTVESALESFDFLNTSDFDEEEDGDEVCNVGGGADSVFSDTETEKHSYRSVHPEARGHLSEALTEDTGVGTSVAGSPLPLTTGNESLDITIVRHLQYCTQLVQQIVFSSKTPFVARSLLEKLSRQIQVMEKLAAVSDENIGNISSVVEAIPEFHKKLSLLSFWTKCCSPVGVYHSPADRVMKQLEASFARTVNKEYPGLADPVFRTLVSQILDQAEPLLSSSLSSEVVTVFQYYSYFTSHGVSDLESYLSQLARQVSMVQTLQSLRDEKLLQTMSDLAPSNLLAQQEVLRTLALLLTREDNEVSEAVTLYLAAASKNQHFREKALLYYCEALTKTNLQLQKAACLALKILEATESIKMLVTLCQSDTEEIRNVASETLLSLGEDGRLAYEQLDKFPRDCVKVGGRHGTEVATAF

SEQ ID NO: 1132 - protein, 810 aa, Homo sapiens
MSKKGRNKGEKPEALIVALQAANEDLRTKLTDIQIELHQEKSKVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLMDEIKAKDRIIFSLEKELETQTGYVQKLQLQKEALDEQLFLVKEAECNMSSPKREIPGRAGDGSEHCSSPDLRRNQKRIAELNATIRKLEDRNTLLGDERNELLKRVRETEKQCKPLLERNKCLAKRNDELMVSLQRMEEKLKAVTKENSEMREKITSHPPLKKLKSLNDLDQANEEQETEFLKLQVIEQQNIIDELTRDREKLIRRRKHRRSSKPIKRPVLDPFIGYDEDSMDSETSSMASFRTDRTPATPDDDLDESLAAEESELRFRQLTKEYQALQRAYALLQEQTGGIIDAEREAKAQEQLQAEVLRYKAKIEDLEATLAQKGQDSHWVEDKQLFIKRNQELLEKIEKQEAENHRLQQELQDARDQNELLEFRNLELEERERRSPPFNLQIHPFSDGVSALQIYCMKEGVKDVNIPDLIKQLDILGDNGNLRNEEQVAIIQASTVLSLAEKWIQQIEGAEAALHQKMMELESDMEQFCKIKGYLEEELDYRKQALDQAYMRIQELEATLYNALQQETVIKFGELLSEKQQEELRTAVEKLRRQMLRKSREYDCQILQERMELLQQAHQRIRDLEDKTDIQKRQIKDLEEKSNRKHG

SEQ ID NO: 1133 - protein, 963 aa, Homo sapiens
MERREEQPGAAGAGAAPALDFTVENVEKALHQLYYDPNIENKNLAQKWLMQAQVSPQAWHFSWQLLQPDKVPEIQYFGASALHIKISRYWSDIPTDQYESLKAQLFTQITRFASGSKIVLTRLCVALASLALSMMPDAWPCAVADMVRLFQAEDSPVDGQGRCLALLELLTVLPEEFQTSRLPQYRKGLVRTSLAVECGAVFPLLEQLLQQPSSPSCVRQKVLKCFSSWVQLEVPLQDCEALIQAAFAALQDSELFDSSVEAIVNAISQPDAQRYVNTLLKLIPLVLGLQEQLRQAVQNGDMETSHGICRIAVALGENHSRALLDQVEHWQSFLALVNMIMFCTGIPGHYPVNETTSSLTLTFWYTLQDDILSFEAEKQAVYQQVYRPVYFQLVDVLLHKAQFPSDEEYGFWSSDEKEQFRIYRVDISDTLMYVYEMLGAELLSNLYDKLGRLLTSSEEPYSWQHTEALLYGFQSIAETIDVNYSDVVPGLIGLIPRISISNVQLADTVMFTIGALSEWLADHPVMINSVLPLVLHALGNPELSVSSVSTLKKICRECKYDLPPYAANIVAVSQDVLMKQIHKTSQCMWLMQALGFLLSALQVEEILKNLHSLISPYIQQLEKLAEEIPNPSNKLAIVHILGLLSNLFTTLDISHHEDDHEGPELRKLPVPQGPNPVVVVLQQVFQLIQKVLSKWLNDAQVVEAVCAIFEKSVKTLLDDFAPMVPQLCEMLGRMYSTIPQASALDLTRQLVHIFAHEPAHFPPIEALFLLVTSVTLTLFQQGPRDHPDIVDSFMQLLAQALKRKPDLFLCERLDVKAVFQCAVLALKFPEAPTVKASCGFFTELLPRCGEVESVGKVVQEDGRMLLIAVLEAIGGQASRSLMDCFADILFALNKHCFSLLSMWIKEALQPPGFPSARLSPEQKDTFSQQILRERVNKRRVKEMVKEFTLLCRGLHGTDYTADY

SEQ ID NO: 1134 - protein, 746 aa, Homo sapiens
ALLSHTRALAGPSPPLRPSSSSWSLLTLPSGRIDVPSASCSRRRGRTFSQKKAAIEREYAQGMQKLASQYLKRDWPGVKADDRNDYRSMYPVWKSFLEGTMQVAQSRMNICENYKNFISEPARTVRSLKEQQLKRCVDQLTKIQTELQETVKDLAKGKKKYFETEQMAHAVREKADIEAKSKLSLFQSRISLQKASVKLKARRSECNSKATHARNDYLLTLAAANAHQDRYYQTDLVNIMKALDGNVYDHLKDYLIAFSRTELETCQAVQNTFQFLLENSSKVVRDYNLQLFLQENAVFHKPQPFQFQPCDSDTSRQLESETGTTEEHSLNKEARKWATRVAREHKNIVHQQRVLNDLECHGAAVSEQSRAELEQKIDEARENIRKAEIIKLKAEARLDLLKQIGVSVDTWLKSAMNQVMEELENERWARPPAVTSNGTLHSLNADTEREEGEEFEDNMDVFDDSSSSPSGTLRNYPLTCKVVYSYKASQPDELTIEEHEVLEVIEDGDMEDWVKARNKVGQVGYVPEKYLQFPTSNSLLSMLQSLAALDSRSHTSSNSTEAELVSGSLNGDASVCFVKALYDYEGQTDDELSFPEGAIIRILNKENQDDDGFWEGEFNGRIGVFPSVLVEELSASENGDTPWMREIQISPSPKPHASLPPLPLYDQPPSSPYPSPDKRSSLYFPRSPSANEKSLHAESPGFSQASRHTPETSYGKLRPVRAAPPPPTQNHRRPAEKIEDVEITLV

SEQ ID NO: 1135 - protein, 1181 aa, Homo sapiens
GGGPAARGGGAGGRRRPHGTRLRSAEDAAALRESAAETRCSSGAKRKISKMFQIPVENLDNIRKVRKKVKGILVDIGLDSCKELLKDLKGFDPGEKYFHNTSWGDVSLWEPSGKKVRYRTKPYCCGLCKYSTKVLTSFKNHLHRYHEDEIDQELVIPCPNCVFASQPKVVGRHFRMFHAPVRKVQNYTVNILGETKSSRSDVISFTCLKCNFSNTLYYSMKKHVLVAHFHYLINSYFGLRTEEMGEQPKTNDTVSIEKIPPPDKYYCKKCNANASSQDALMYHILTSDIHRDLENKLRSVISEHIKRTGLLKQTHIAPKPAAHLAAPANGSAPSAPAQPPCFHLALPQNSPSPAAGQPVTVAQGAPGSLTHSPPAAGQSHMTLVSSPLPVGQNSLTLQPPAPQPVFLSHGVPLHQSVNPPVLPLSQPVGPVNKSVGTSVLPINQTVRPGVLPLTQPVGPINRPVGPGVLPVSPSVTPGVLQAVSPGVLSVSRAVPSGVLPAGQMTPAGQMTPAGVIPGQTATSGVLPTGQMVQSGVLPVGQTAPSRVLPPGQTAPLRVISAGQVVPSGLLSPNQTVSSSAVVPVNQGVNSGVLQLSQPVVSGVLPVGQPVRPGVLQLNQTVGTNILPVNQPVRPGASQNTTFLTSGSILRQLIPTGKQVNGIPTYTLAPVSVTLPVPPGGLATVAPPQMPIQLLPSGAAAPMAGSMPGMPSPPVLVNAAQSVFVQASSSAADTNQVLKQAKQWKTCPVCNELFPSNVYQVHMEVAHKHSESKSGEKLEPEKLAACAPFLKWMREKTVRCLSCKCLVSEEELIHHLLMHGLGCLFCPCTFHDIKGLSEHSRNRHLGKKKLPMDYSNRGFQLDVDANGNLLFPHLDFITILPKEKLGEREVYLAILAGIHSKSLVPVYVKVRPQAEGTPGSTGKRVSTCPFCFGPFVTTEAYELHLKERHHIMPTVHTVLKSPAFKCIHCCGVYTGNMTLAAIAVHLVRCRSAPKDSSSDLQAQPGFIHNSELLLVSGEVMHDSSFSVKRKLPDGHLGAEDQRHGEEQPPILNADAAPGPEKVTSVVPFKRQRNESRTEGPIVKDEALQILALDPKKYEGRSYEEKKQFLKDYFHKKPYPSKKEIELLSSLFWVWKIDVASFFGKRRYICMKAIKNHKPSVLLGFDMSELKNVKHRLNFEYEP

SEQ ID NO: 1136 - protein, 892 aa, Homo sapiens
MTDPFCVGGRRLPGSSKSGPGKDGSRKEVRLPMLHDPPKMGMPVVRGGQTVPGQAPLCFDPGSPASDKTEGKKKGRPKAENQALRDIPLSLMNDWKDEFKAHSRVKCPNSGCWLEFPSIYGLKYHYQRCQGGAISDRLAFPCPFCEAAFTSKTQLEKHRIWNHMDRPLPASKPGPISRPVTISRPVGVSKPIGVSKPVTIGKPVGVSKPIGISKPVSVGRPMPVTKAIPVTRPVPVTKPVTVSRPMPVTKAMPVTKPITVTKSVPVTKPVPVTKPITVTKLVTVTKPVPVTKPVTVSRPIVVSKPVTVSRPIAISRHTPPCKMVLLTRSENKAPRATGRNSGKKRAADSLDTCPIPPKQARPENGEYGPSSMGQSSAFQLSADTSSGSLSPGSRPSGGMEALKAAGPASPPEEDPERTKHRRKQKTPKKFTGEQPSISGTFGLKGLVKAEDKARVHRSKKQEGPGPEDARKKVPAAPITVSKEAPAPVAHPAPGGPEEQWQRAIHERGEAVCPTCNVVTRKTLVGLKKHMEVCQKLQDALKCQHCRKQFKSKAGLNYHTMAEHSAKPSDAEASEGGEQEERERLRKVLKQMGRLRCPQEGCGAAFSSLMGYQYHQRRCGKPPCEVDSPSFPCTHCGKTYRSKAGHDYHVRSEHTAPPPEEPTDKSPEAEDPLGVERTPSGRVRRTSAQVAVFHLQEIAEDELARDWTKRRMKDDLVPETARLNYTRPGLPTLNPQLLEAWKNEVKEKGHVNCPNDCCEAIYSSVSGLKAHLASCSKGAHLAGKYRCLLCPKEFSSESGVKYHILKTHAENWFRTSADPPPKHRSQDSLVPKKEKKKNLAGGKKRGRKPKERTPEEPVAKLPPRRDDWPPGCRDKGARGSTGRKVGVSKAPEK

SEQ ID NO: 1137 - protein, 1368 aa, Homo sapiens
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVEKIICNLKPALKLRLRFITHISKMEPAAVPPQAMNSGSPAPQSNQVPVSLPVTQ

SEQ ID NO: 1138 - protein, 529 aa, Homo sapiens
MSSTVSYWILNSTRNSIATLQGGRRLYSRYVSNRNKLKWRLFSRVPPTLNSSPCGGFTLCKAYRHTSTEEDDFHLQLSPEQINEVLRAGETTHKILDLESRVPNSVLRFESNQLAANSPVEDRRGVASCLQTNGLMFGIFDGHGGHACAQAVSERLFYYVAVSLMSHQTLEHMEGAMESMKPLLPILHWLKHPGDSIYKDVTSVHLDHLRVYWQELLDLHMEMGLSIEEALMYSFQRLDSDISLEIQAPLEDEVTRNLSLQVAFSGATACMAHVDGIHLHVANAGDCRAILGVQEDNGMWSCLPLTRDHNAWNQAELSRLKREHPESEDRTIIMEDRLLGVLIPCRAFGDVQLKWSKELQRSILERGFNTEALNIYQFTPPHYYTPPYLTAEPEVTYHRLRPQDKFLVLASDGLWDMLSNEDVVRLVVGHLAEADWHKTDLAQRPANLGLMQSLLLQRKASGLHEADQNAATRLIRHAIGNNEYGEMEAERLAAMLTLPEDLARMYRDDITVTVVYFNSESIGAYYKGG

SEQ ID NO: 1139 - protein, 1040 aa, Homo sapiens
MIVLLLFALLWMVEGVFSQLHYTVQEEQEHGTFVGNIAEDLGLDITKLSARGFQTVPNSRTPYLDLNLETGVLYVNEKIDREQICKQSPSCVLHLEVFLENPLELFQVEIEVLDINDNPPSFPEPDLTVEISESATPGTRFPLESAFDPDVGTNSLRDYEITPNSYFSLDVQTQGDGNRFAELVLEKPLDREQQAVHRYVLTAVDGGGGGGVGEGGGGGGGAGLPPQQQRTGTALLTIRVLDSNDNVPAFDQPVYTVSLPENSPPGTLVIQLNATDPDEGQNGEVVYSFSSHISPRARELFGLSPRTGRLEVSGELDYEESPVYQVYVQAKDLGPNAVPAHCKVLVRVLDANDNAPEISFSTVKEAVSEGAAPGTVVALFSVTDRDSEENGQVQCELLGDVPFRLKSSFKNYYTIVTEAPLDREAGDSYTLTVVARDRGEPALSTSKSIQVQVSDVNDNAPRFSQPVYDVYVTENNVPGAYIYAVSATDRDEGANAQLAYSILECQIQGMSVFTYVSINSENGYLYALRSFDYEQLKDFSFQVEARDAGSPQALAGNATVNILIVDQNDNAPAIVAPLPGRNGTPAREVLPRSAEPGYLLTRVAAVDADDGENARLTYSIVRGNEMNLFRMDWRTGELRTARRVPAKRDPQRPYELVIEVRDHGQPPLSSTATLVVQLVDGAVEPQGGGGSGGGGSGEHQRPSRSGGGETSLDLTLILIIALGSVSFIFLLAMIVLAVRCQKEKKLNIYTCLASDCCLCCCCCGGGGSTCCGRQARARKKKLSKSDIMLVQSSNVPSNPAQVPIEESGGFGSHHHNQNYCYQVCLTPESAKTDLMFLKPCSPSRSTDTEHNPCGAIVTGYTDQQPDIISNGSILSNETKHQRAELSYLVDRPRRVNSSAFQEADIVSSKDSGHGDSEQGDSDHDATNRAQSAGMDLFSNCTEECKALGHSDRCWMPSFVPSDGRQAADYRSNLHVPGMDSVPDTEVFETPEAQPGAERSFSTFGKEKALHSTLERKELDGLLTNTRAPYKPPYLTRKRIC

SEQ ID NO: 1140 - protein, 612 aa, Homo sapiens [sequence omitted]

SEQ ID NO: 1141 - protein, 1117 aa, Homo sapiens
MRKLLSFGRRLGQALLSSMDQEYAGRGYHIRDWELRKIHRAAIKGDAAEVEHCLTRRFRDLDVRDRKDRTVLHLACAHGRVQVVTLLLDRKCQINICDRLNRTPLMKAVHCQEEACAIILLKRGANPNIKDIYGNTALHYAVYNEGTSLAERLLSHHANIEALNKEGNTPLLFAINSRRQHMVEFLLKNQANIHAVDNFKRTALILAVQHNLSSIVTLLLQQNIHISSQDMFGQTAEDYAFCCDLRSIQQQILEHKNKMLKNHLRNDNQEAAAMKNESFKTQGASSKVSLYHQSGVQWHDLRLLQPSPPRFKQFSCLSLPRSWDNRHMRPCPETAAMKPENLKKRKKRKKLKKRKEGAKEHNLKVASEEKQERLERSENKQPQDSQSYGKKKDEMFGNFMLKRDIAMLKEELYAIKNDSLRKEKKYIQEIKSITEINANFEKSVRLNEEMITKKVAQYSQQLNDLKAENARLNSKLEKEKHNKERLEAEVESLHSNLATAINEYNEILERKDLELVLWRADDVSRHETMGSNISQLTDKNELLTEQVHKARVKFNTLKGKLRETRDALREKTLALESVQLDLKQAQHRIKEMKQMHPNGEAKESQSIGKQNSSEERIRQRELENLLLERQLEDARKEGDNKEIVINIHRDCLENGKEDLLEERNKELMNEYNYLKEKLLQYEKEKAEREVIVREFQEELVDHLKKFSMSESPLEGTSHCHINLDETWTSKKKLFQVEIQPEEKHEEFRKVFELISLLNYTADQIRKKNRELEEEATGYKKCLEMTINMLNAFANEDFSCHGDLNTDQLKMDILFKKLKQKFDDLMAEKEAVSSKCVNLAKDNEVLHQELLSMGKVQEKCEKLEKDKKMLEEKVLNLKTHMEKDMVELGKVQEYKSELDERAMQAIEKLEEIHLQKQAEYEKQLEQLNKDNTASLKKKELTLKDVECKFSKMKTAYEDVTTELEEYKEAFAVALKANSSMSEKITKSDKKIAVISTKLFMEKERMEYFLSTLPMRPDPELPCVENLNSIELNRKYIPKMAIRIPTSNPQTSNNCKNSLTEMELDCAEQIITETKKIINLCIPSTRKPMILTQNFCCVGPLLLSTFFSRIHCPRMSNFS

SEQ ID NO: 1142 - protein, 393 aa, Homo sapiens
MGKSDFLTPKAIANRIKSKGLQKLRWYCQMCQKQCRDENGFKCHCMSESHQRQLLLASENPQQFMDYFSEEFRNDFLELLRRRFGTKRVHNNIVYNEYISHREHIHMNATQWETLTDFTKWLGREGLCKVDETPKGWYIQYIDRDPETIRRQLELEKKKKQDLDDEEKTAKFIEEQVRRGLEGKEQEVPTFTELSRENDEEKVTFNLSKGACSSSGATSSKSSTLGPSALKTIGSSASVKRKESSQSSTQSKEKKKKKSALDEIMEIEEEKKRTARTDYWLQPEIIVKIITKKLGEKYHKKKAIVKEVIDKYTAVVKMIDSGDKLKLDQTHLETVIPAPGKRILVLNGGYRGNEGTLESINEKTFSATIVIETGPLKGRRVEGIQYEDISKLA

SEQ ID NO: 1143 - protein, 1805 aa, Homo sapiens
MSDTKVKVAVRVRPMNRRELELNTKCVVEMEGNQTVLHPPPSNTKQGERKPPKVFAFDYCFWSMDESNTTKYAGQEVVFKCLGEGILEKAFQGYNACIFAYGQTGSGKSFSMMGHAEQLGLIPRLCCALFKRISLEQNESQTFKVEVSYMEIYNEKVRDLLDPKGSRQSLKVREHKVLGPYVDGLSQLAVTSFEDIESLMSEGNKSRTVAATNMNEESSRSHAVFNIIITQTLYDLQSGNSGEKVSKVSLVDLAGSERVSKTGAAGERLKEGSNINKSLTTLGLVISSLADQAAGKGKSKFVPYRDSVLTWLLKDNLGGNSQTSMIATISPAADNYEETLSTLRYADRAKRIVNHAVVNEDPNAKVIRELREEVEKLREQLSQAEAMKAPELKEKLEESEKLIKELTVTWEEKLRKTEEIAQERQRQLESMGISLEMSGIKVGDDKCYLVNLNADPALNELLVYYLKDHTRVGADTSQDIQLFGIGIQPQHCEIDIASDGDVTLTPKENARSCVNGTLVCSTTQLWHGDRILWGNNHFFRINLPKRKRRDWLKDFEKETGPPEHDLDAASEASSEPDYNYEFAQMEVIMKTLNSNDPVQNVVQVLEKQYLEEKRSALEEQRLMYERELEQLRQQLSPDRQPQSSGPDRLAYSSQTAQQKVTQWAEERDELFRQGLAKLREQLVKANTLVREANFLAEEMSKLTDYQVTLQIPAANLSANRKRGAIVSEPAIQVRRKGKSTQVWTIEKLENKLIDMRDLYQEWKEKVPEAKRLYGKRGDPFYEAQENHNLIGVANVFLECLFCDVKLQYAVPIISQQGEVAGRLHVEVMRVTGAVPERVVEDDSSENSSESGSLEVVDSSGEIIHRVKKLTCRVKIKEATGLPLNLSNFVFCQYTFWDQCESTVAAPVVDPEVPSPQSKDAQYTVAFSHCKDYVVNVTEEFLEFISDGALAIEVWGHRCAGNGSSIWEVDSLHAKTRTLHDRWNEVTRRIEMWISILELNELGEYAAVELHQAKDVNTGGIFQLRQGHSRRVQVTVKPVQHSGTLPLMVEAILSVSIGCVTARSTKLQRGLDSYQRDDEDGDDMDSYQEEDLNCVRERWSDALIKRREYLDEQIKKVSNKTEKTEDDVEREAQLVEQWVGLTEERNAVLVPAPGSGIPGAPADWIPPPGMETHIPVLFLDLNADDPSANEQLVGPHASGVNSILPKEHGSQFFYLPIIKHSDDEVSATASWDSSVHDSVHLNRVTPQNERIYLIVKTTVQLSHPAAMELVLRKRIAANIYNKQSFTQSLKRRISLKNIFYSCGVTYEIVSNIPKATEEIEDRETLALLAARSENEGTSDGETYIEKYTRGVLQVENILSLERLRQAVTVKEALSTKARHIRRSLSTPNVHNVSSSRPDLSGFDEDDKGWPENQLDMSDYSSSYQDVACYGTLPRDSPRRNKEGCTSETPHALTVSPFKAFSPQPPKFFKPLMPVKEEHKKRIALEARPLLSQESMPPPQAHNPGCIVPSGSNGSSMPVEHNNKREKKIDSEEEENELEAINRKLISSQPYVPVEFADFSVYNASLENREWFSSKVDLSNSRVLEKEVSRSPTTSSITSGYFSHSASNATLSDMVVPSSDSSDQLAIQTKDADSTEHSTPSLVHDFRPSSNKELTEVEKGLVKDKIIVVPLKENSALAKGSPSSQSIPEKNSKSLCRTGSCSELDACPSKISQPARGFCPREVTVEHTTNILEDHSFTEFMGVSEGKDFDGLTDSSAGELSSRRSLPNKTGGKTVSDGLHHPSQLHSKLENDQVIIPEAAFWVLCCQ

SEQ ID NO: 1144 - protein, 579 aa, Homo sapiens
MNKLYIGNLSENAAPSDLESIFKDAKIPVSGPFLVKTGYAFVDCPDESWALKAIEALSGKIELHGKPIEVEHSVPKRQRIRKLQIRNIPPHLQWEVLDSLLVQYGVVESCEQVNTDSETAVVNVTYSSKDQARQALDKLNGFQLENFTLKVAYIPDEMAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPLQELTLYNPERTITVKGNVETCAKAEEEIMKKIRESYENDIASMNLQAHLIPGLNLNALGLFPPTSGMPPPTSGPPSAMTPPYPQFEQSETETVHQFIPALSVGAIIGKQGQHIKQLSRFAGASIKIAPAEAPDAKVRMVIITGPPEAQFKAQGRIYGKIKEENFVSPKEEVKLEAHIRVPSFAAGRVIGKGGKTVNELQNLSSAEVVVPRDQTPDENDQVVVKITGHFYACQVAQRKIQEILTQVKQHQQQKALQSGPPQSRRK

SEQ ID NO: 1145 - protein, 428 aa, Homo sapiens
SFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLETEIEALKEELLFMKKNHEEEVKGLQAQIASSGLTVEVDAPKSQDLAKIMADIRAQYDELARKNREELDKYWSQQIEESTTVVTTQSAEVGAAETTLTELRRTVQSLEIDLDSMRNLKASLENSLREVEARYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLR

SEQ ID NO: 1146 - protein, 629 aa, Homo sapiens
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKVLYRIYHGLLTAEKGTVEFSHTKDYTGNRLLLLNVP

SEQ ID NO: 1147 - protein, 772 aa, Homo sapiens
MRRREGHGTDSEMGQGPVRESQSSDPPALQFRISEYKPLNMAGVEQPPSPELRQEGVTEYEDGGAPAGDGEAGPQQAEDHPQNPPEDPNQDPPEDDSTCQCQACGPHQAAGPDLGSSNDGCPQLFQERSVIVENSSGSTSASELLKPMKKRKRREYQSPSEEESEPEAMEKQEEGKDPEGQPTASTPESEEWSSSQPATGEKKECWSWESYLEEQKAITAPVSLFQDSQAVTHNKNGFKLGMKLEGIDPQHPSMYFILTVAEVCGYRLRLHFDGYSECHDFWVNANSPDIHPAGWFEKTGHKLQPPKGYKEEEFSWSQYLRSTRAQAAPKHLFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDSEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEARIVRVTHVSGKTLVWTVAQLGDLVCSDHLQEGKGILETGVHSLLCSLPTHLLAKLSFASDSQY

SEQ ID NO: 1148 - protein, 387 aa, Homo sapiens
MPRPRLLAALCGALLCAPSLLVALDICSKNPCHNGGLCEEISQEVRGDVFPSYTCTCLKGYAGNHCETKCVEPLGMENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 1149 - protein, 664 aa, Homo sapiens
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 1150 - protein, 1609 aa, Homo sapiens [sequence omitted]

SEQ ID NO: 1151 - protein, 1615 aa, Homo sapiens; identical to SEQ ID NO: 985

SEQ ID NO: 1152 - protein, 1165 aa, Homo sapiens
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKPETFEHLFIKHTASVTCGPLLLEPETISEDISVDTSWKNKDEMMPTTVVSLLSTTDLEKGSVCISDQFNSVNFSEAEGTEVTYEAESQRQPFVKYATLISNSKPSETGEEQGLINSSVTKCFSSKNSPLKDSFSNSSWEIEAQAFFILSDQHPNIISPHLTFSEGLDELLKLEGNFPEENNDKKSIYYLGVTSIKKRESGVLLTDKSRVSCPFPAPCLFTDIRVLQDSCSHFVENNINLGTSSKKTFASYMPQFQTCSTQTHKIMENKMCDLTV

SEQ ID NO: 1153 - protein, 966 aa, Homo sapiens
MANFQEHLSCSSSPHLPFSESKTFNGLQDELTAMGNHPSPKLLEDQQEKGMVRTELIESVHSPVTTTVLTSVSEDSRDQFENSVLQLREHDESETAVSQGNSNTVDGESTSGTEDIKIQFSRSGSGSGGFLEGLFGCLRPVWNIIGKAYSTDYKLQQQDTWEVPFEEISELQWLGSGAQGAVFLGKFRAEEVAIKKVREQNETDIKHLRKLKHPNIIAFKGVCTQAPCYCIIMEYCAHGQLYEVLRAGRKITPRLLVDWSTGIASGMNYLHLHKIIHRDLKSPNVLVTHTDAVKISDFGTSKELSDKSTKMSFAGTVAWMAPEVIRNEPVSEKVDIWSFGVVLWELLTGEIPYKDVDSSAIIWGVGSNSLHLPVPSTCPDGFKILMKQTWQSKPRNRPSFRQTLMHLDIASADVLATPQETYFKSQAEWREEVKKHFEKIKSEGTCIHRLDEELIRRRREELRHALDIREHYERKLERANNLYMELSAIMLQLEMREKELIKREQAVEKKYPGTYKRHPVRPIIHPNAMEKLMKRKGVPHKSGMQTKRPDLLRSEGIPTTEVAPTASPLSGSPKMSTSSSKSRYRSKPRHRRGNSRGSHSDFAAILKNQPAQENSPHPTYLHQAQSQYPSLHHHNSLQQQYQQPPPAMSQSHHPRLNMHGQDIATCANNLRYFGPAAALRSPLSNHAQRQLPGSSPDLISTAMAADCWRSSEPDKGQAGPWGCCQADAYDPCLQCRPEQYGSLDIPSAEPVGRSPDLSKSPAHNPLLENAQSSEKTEENEFSGCRSESSLGTSHLGTPPALPRKTRPLQKSGDDSSEEEEGEVDSEVEFPRRQRPHRCISSCQSYSTFSSENFSVSDGEEGNTSDHSNSPDELADKLEDRLAEKLDDLLSQTPEIPIDISSHSDGLSDKECAVRRVKTQMSLGKLCVEERGYENPMQFEESDCDSSDGECSDATVRTNKHYSSATW

SEQ ID NO: 1154 - protein, 652 aa, Homo sapiens
MAMDEYLWMVILGFIIAFILAFSVGANDVANSFGTAVGSGVVTLRQACILASIFETTGSVLLGAKVGETIRKGIIDVNLYNETVETLMAGEVSAMVGSAVWQLIASFLRLPISGTHCIVGSTIGFSLVAIGTKGVQWMELVKIVASWFISPLLSGFMSGLLFVLIRIFILKKEDPVPNGLRALPVFYAATIAINVFSIMYTGAPVLGLVLPMWAIALISFGVALLFAFFVWLFVCPWMRRKITGKLQKEGALSRVSDESLSKVQEAESPVFKELPGAKANDDSTIPLTGAAGETLGTSEGTSAGSHPRAAYGRALSMTHGSVKSPISNGTFGFDGHTRSDGHVYHTVHKDSGLYKDLLHKIHIDRGPEEKPAQESNYRLLRRNNSYTCYTAAICGLPVHATFRAADSSAPEDSEKLVGDTVSYSKKRLRYDSYSSYCNAVAEAEIEAEEGGVEMKLASELADPDQPREDPAEEEKEEKDAPEVHLLFHFLQVLTACFGSFAHGGNDVSNAIGPLVALWLIYKQGGVTQEAATPVWLLFYGGVGICTGLWVWGRRVIQTMGKDLTPITPSSGFTIELASAFTVVIASNIGLPVSTTHCKVGSVVAVGWIRSRKAVDWRLFRNIFVAWFVTVPVAGLFSAAVMALLMYGILPYV

SEQ ID NO: 1155 - protein, 2136 aa, Homo sapiens
MSRSRHARPSRLVRKEDVNKKKKNSQLRKTTKGANKNVASVKTLSPGKLKQLIQERDVKKKTEPKPPVPVRSLLTRAGAARMNLDRTEVLFQNPESLTCNGFTMALRSTSLSRRLSQPPLVVAKSKKVPLSKGLEKQHDCDYKILPALGVKHSENDSVPMQDTQVLPDIETLIGVQNPSLLKGKSQETTQFWSQRVEDSKINIPTHSGPAAEILPGPLEGTRCGEGLFSEETLNDTSGSPKMFAQDTVCAPFPQRATPKVTSQGNPSIQLEELGSRVESLKLSDSYLDPIKSEHDCYPTSSLNKVIPDLNLRNCLALGGSTSPTSVIKFLLAGSKQATLGAKPDHQEAFEATANQQEVSDTTSFLGQAFGAIPHQWELPGADPVHGEALGETPDLPEIPGAIPVQGEVFGTILDQQETLGMSGSVVPDLPVFLPVPPNPIATFNAPSKWPEPQSTVSYGLAVQGAIQILPLGSGHTPQSSSNSEKNSLPPVMAISNVENEKQVHISFLPANTQGFPLAPERGLFHASLGIAQLSQAGPSKSDRGSSQVSVTSTVHVVNTTVVTMPVPMVSTSSSSYTTLLPTLEKKKRKRCGVCEPCQQKTNCGECTYCKNRKNSHQICKKRKCEELKKKPSVVVPLEVIKENKRPQREKKPKVLKADFDNKPVNGPKSESMDYSRCGHGEEQKLELNPHTVENVTKNEDSMTGIEVEKWTQNKKSQLTDHVKGDFSANVPEAEKSKNSEVDKKRTKSPKLFVQTVRNGIKHVHCLPAETNVSFKKFNIEEFGKTLENNSYKFLKDTANHKNAMSSVATDMSCDHLKGRSNVLVFQQPGFNCSSIPHSSHSIINHHASIHNEGDQPKTPENIPSKEPKDGSPVQPSLLSLMKDRRLTLEQVVAIEALTQLSEAPSENSSPSKSEKDEESEQRTASLLNSCKAILYTVRKDLQDPNLQGEPPKLNHCPSLEKQSSCNTVVFNGQTTTLSNSHINSATNQASTKSHEYSKVTNSLSLFIPKSNSSKIDTNKSIAQGIITLDNCSNDLHQLPPRNNEVEYCNQLLDSSKKLDSDDLSCQDATHTQIEEDVATQLTQLASIIKINYIKPEDKKVESTPTSLVTCNVQQKYNQEKGTMQQKPPSSVHNNHGSSLTKQKNPTQKKTKSTPSRDRRKKKPTVVSYQENDRQKWEKLSYMYGTICDIWIASKFQNFGQFCPHDFPTVFGKISSSTKIWKPLAQTRSIMQPKTVFPPLTQIKLQRYPESAEEKVKVEPLDSLSLFHLKTESNGKAFTDKAYNSQVQLTVNANQKAHPLTQPSSPPNQCANVMAGDDQIRFQQVVKEQLMHQRLPTLPGISHETPLPESALTLRNVNVVCSGGITVVSTKSEEEVCSSSFGTSEFSTVDSAQKNFNDYAMNFFTNPTKNLVSITKDSELPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 1156 - protein, 1123 aa, Homo sapiens [sequence omitted]

SEQ ID NO: 1157 - protein, 110 aa, Homo sapiens
MLLTRFEQKNGHLAQVEVDEVFGFMCHITTEVPPHDAMPGGIVLLVKFLLDMSRNVLLYVVFLQRLSSALHRVLLHLFRHVRIFDHGLSVAHGYRGEGGWPTATVSWGRC

SEQ ID NO: 1158 - protein, 729 aa, Homo sapiens
AAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKVMATTGGMGMGPGGPGMITIPPSILNNPNIPNEIIHALQAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 1159 - protein, 114 aa, Homo sapiens
PMFIVNTNVPRASVPDGFLSELTQQLAQATGKPPQYIAVHVVPDQLMAFGGSSEPCALCSLHSIGKIGGAQNRSYSKLLCGLLAERLRISPDRVYINYYDMNAANVGWNNSTFA

SEQ ID NO: 1160 - protein, 211 aa, Homo sapiens
MTTLTRQDLNFGQVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSISSDSLLSHVEQLLRAFILKISVCDAVLDHNPPGCTFTVLVHTREAATRNMEKIQVIKDFPWILADEQDVHMHDPRLIPLKTMTSDILKMQLYVEERAHKGS

SEQ ID NO: 1161 - protein, 1607 aa, Homo sapiens
MREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKEKMNAPNQPPHKDTGKTVENVEEYSYKQEKKIRAALRTTERDHKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIIRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTGLYLAIHRNSPRPMKVPRCHSDPPNPHLIIPTPEGFSTRSMPSDARSHGSPAAAAAAAAAVAASRPSPSGGDSVLPKSISSAHDTRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 1162 - protein, 313 aa, Homo sapiens
MPGLLLCEPTELYNILNQATKLSRLTDPNYLCLLDVRSKWEYDESHVITALRVKKKNNEYLLPESVDLECVKYCVVYDNNSSTLEILLKDDDDDSDSDGDGKDLVPQAAIEYGRILTRLTHHPVYILKGGYERFSGTYHFLRTQKIIWMPQELDAFQPYPIEIVPGKVFVGNFSQACDPKIQKDLKIKAHVNVSMDTGPFFAGDADKLLHIRIEDSPEAQILPFLRHMCHFIEIHHHLGSVILIFSTQGISRSCAAIIAYLMHSNEQTLQRSWAYVKKCKNNMCPNRGLVSQLLEWEKTILGDSITNIMDPLY

SEQ ID NO: 1163 - protein, 1798 aa, Homo sapiens
MKRSRCRDRPQPPPPDRREDGVQRAAELSQSLPPRRRAPPGRQRLEERTGPAGPEGKEQDVVTGVSPLLFRKLSNPDIFSSTGKVKLQRQLSQDDCKLWRGNLASSLSGKQLLPLSSSVHSSVGQVTWQSSGEASNLVRMRNQSLGQSAPSLTAGLKELSLPRRGSFCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKATAQMEERLAEFISSNTPDSVLPLADGALSFIHHQVIEMARDCLDKSRSGLITSQYFYELQDNLEKLLQDAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKIGLMSLTTNLYEGHIEKDAREFLDKQVCGTPEYIAPEVILRQGYGKPVDWWAMGIILYEFLVGCVPFFGDTPEELFGQVISDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEILRKRLSVSESSHTESDSSPPMTVRRRCSGLLDAPRFPEGPEEASSTLRRQPQEGIWVLTPPSGEGVSGPVTEHSGEQRPKLDEEAVGRSSGSSPAMETRGRGTSQLAEGATAKAISDLAVRRARHRLLSGDSTEKRTARPVNKVIKSASATALSLLIPSEHHTCSPLASPMSPHSQSSNPSSRDSSPSRDFLPALGSMRPPIIIHRAGKKYGFTLRAIRVYMGDSDVYTVHHMVWHVEDGGPASEAGLRQGDLITHVNGEPVHGLVHTEVVELILKSGNKVAISTTPLENTSIKVGPARKGSYKAKMARRSKRSRGKDGQESRKRSSLFRKITKQASLLHTSRSLSSLNRSLSSGESGPGSPTHSHSLSPRSPTQGYRVTPDAVHSVGGNSSQSSSPSSSVPSSPAGSGHTRPSSLHGLAPKLQRQYRSPRRKSAGSIPLSPLAHTPSPPPPTASPQRSPSPLSGHVAQAFPTKLHLSPPLGRQLSRPKSAEPPRSPLLKRVQSAEKLAAALAASEKKLATSRKHSLDLPHSELKKELPPREVSPLEVVGARSVLSGKGALPGKGVLQPAPSRALGTLRQDRAERRESLQKQEAIREVDSSEDDTEEGPENSQGAQELSLAPHPEVSQSVAPKGAGESGEEDPFPSRDPRSLGPMVPSLLTGITLGPPRMESPSGPHRRLGSPQAIEEAASSSSAGPNLGQSGATDPIPPEGCWKAQHLHTQALTALSPSTSGLTPTSSCSPPSSTSGKLSMWSWKSLIEGPDRASPSRKATMAGGLANLQDLENTTPAQPKNLSPREQGKTQPPSAPRLAHPSYEDPSQGWLWESECAQAVKEDPALSITQVPDASGDRRQDVPCRGCPLTQKSEPSLRRGQEPGGHQKHRDLALVPDELLKQT

SEQ ID NO: 1164 - protein, 513 aa, Homo sapiens
MKRLLLLFLFFITFSSAFPLVRMMENEENVQLAQAYLNQFYSLEIEGNHLVQSKNRSLIDDKIREMQAFFGLTVTGKLDSNTLEIMKTPRCGVPDVGQYGYTLPGWRKYNLTYRIINYTPDMARAAVDEAIQEGLEVWSKVTPLKFTKISKGIADIMIAFRTRVHGRCPRYFDGPLGVLGHAFPPGPGLGGDTHFDEDENWTKDGAGFNLFLVAAHEFGHALGLSHSNDQTALMFPNYVSLDPRKYPLSQDDINGIQSIYGGLPKEPAKPKEPTIPHACDPDLTFDAITTFRREVMFFKGRHLWRIYYDITDVEFELIASFWPSLPADLQAAYENPRDKILVFKDENFWMIRGYAVLPDYPKSIHTLGFPGRVKKIDAAVCDKTTRKTYFFVGIWCWRFDEMTQTMDKGFPQRVVKHFPGISIRVDAAFQYKGFFFFSRGSKQFEYDIKTKNITRIMRTNTWFQCKEPKNSSFGFDINKEKAHSGGIKILYHKSLSLFIFGIVHLLKNTSIYQ

SEQ ID NO: 1165 - protein, 556 aa, Homo sapiens
LNDLRDLTQCVSLFLFGEVHKALWKTEQGTVVGILNANPMKPKDGSEEVCLSIDHPQKVLIMGEALDLGTCKAKKKNGEPCTQTVNLRDCEYCQYHVQAQYKKLSAKRADLQSTFSGGRIPKKFARRGTSLKERLCQDGFYYGGVSSASYAASIAAAVAPKKKIQTTLSNLVVKGTNLIIQETRQKLGIPQKSLSCSEEFKELMDLPTCGARNLKQHLAKATASGIMGSPKPAIKSISASALLKQQKQRMLEMRRRKSEEIQKRFLQSSSEVESPAVPSSSRQPPAQPPRTGSEFPRLEGAPATMTPKLGRGVLEGDDVLFYDESPPPRPKLSALAEAKKLAAITKLRAKGQVLTKTNPNSIKKKQKDPQDILEVKERVEKNTMFSSQAEDELEPARKKRREQLAYLESEEFQKILKAKSKHTGILKEAEAEMQERYFEPLVKKEQMEEKMRNIREVKCRVVTCKTCAYTHFKLLETCVSEQHEYHWHDGVKRFFKCPCGNRSISLDRLPNKHCSNCGLYKWERDGMLKEKTGPKIGGETLLPRGEEHAKFLNSLK

SEQ ID NO: 1166 - protein, 1025 aa, Homo sapiens
MSNGYSTDENFRYLISCFRARVKMYIQVEPVLDYLTFLPAEVKEQIQRTVATSGNMQAVELLLSTLEKGVWHLGWTREFVEALRRTGSPLAARYMNPELTDLPSPSFENAHDEYLQLLNLLQPTLVDKLLVRDVLDKCMEEELLTIEDRNRIAAAENNGNESGVRELLKRIVQKENWFSAFLNVLRQTGNNELVQELTGSDCSESNAEIENLSQVDGPQVEEQLLSTTVQPNLEKEVWGMENNSSESSFADSSVVSESDTSLAEGSVSCLDESLGHNSNMGSDSGTMGSDSDEENVAARASPEPELQLRPYQMEVAQPALEGKNIIICLPTGSGKTRVAVYIAKDHLDKKKKASEPGKVIVLVNKVLLVEQLFRKEFQPFLKKWYRVIGLSGDTQLKISFPEVVKSCDIIISTAQILENSLLNLENGEDAGVQLSDFSLIIIDECHHTNKEAVYNNIMRHYLMQKLKNNRLKKENKPVIPLPQILGLTASPGVGGATKQAKAEEHILKLCANLDAFTIKTVKENLDQLKNQIQEPCKKFAIADATREDPFKEKLLEIMTRIQTYCQMSPMSDFGTQPYEQWAIQMEKKAAKEGNRKERVCAEHLRKYNEALQINDTIRMIDAYTHLETFYNEEKDKKFAVIEDDSDEGGDDEYCDGDEDEDDLKKPLKLDETDRFLMTLFFENNKMLKRLAENPEYENEKLTKLRNTIMEQYTRTEESARGIIFTKTRQSAYALSQWITENEKFAEVGVKAHHLIGAGHSSEFKPMTQNEQKEVISKFRTGKINLLIATTVAEEGLDIKECNIVIRYGLVTNEIAMVQARGRARADESTYVLVAHSGSGVIERETVNDFREKMMYKAIHCVQNMKPEEYAHKILELQMQSIMEKKMKTKRNIAKHYKNNPSLITFLCKNCSVLACSGEDIHVIEKMHHVNMTPEFKELYIVRENKALQKKCADYQINGEIICKCGQAWGTMMVHKGLDLPCLKIRNFVVVFKNNSTKKQYKKWVELPITFPNLDYSECCLFSDED

SEQ ID NO: 1167 - protein, 711 aa, Homo sapiens [sequence omitted]

SEQ ID NO: 1168 - protein, 606 aa, Homo sapiens
MSDTSESGAGLTRFQAEASEKDSSSMMQTLLTVTQNVEVPETPKASKALEVSEDVKVSKASGVSKATEVSKTPEAREAPATQASSTTQLTDTQVLAAENKSLAADTKKQNADPQAVTMPATETKKVSHVADTKVNTKAQETEAAPSQAPADEPEPESAAAQSQENQDTRPKVKAKKARKVKHLDGEEDGSSDQSQASGTTGGRRVSKALMASMARRASRGPIAFWARRASRTRLAAWARRALLSLRSPKARRGKARRRAAKLQSSQEPEAPPPRDVALLQGRANDLVKYLLAKDQTKIPIKRSDMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGAGASTSGSSGACGFSYK

SEQ ID NO: 1169 - protein, 661 aa, Homo sapiens
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 1170 - protein, 649 aa, Homo sapiens
MKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEADSAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPDNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPAMDSEEDMMVTALHSLTLQTVVIHSLSSVLPGITLAINGMDISRISSEALGRVDHGEPHEVVEGPQDPTEGCRK

SEQ ID NO: 1171 - protein, 1390 aa, Homo sapiens [sequence omitted]

SEQ ID NO: 1172 - protein, 359 aa, Homo sapiens
SQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 1173 - protein, 819 aa, Homo sapiens [sequence omitted]

SEQ ID NO: 1174 - protein, 1820 aa, Homo sapiens [sequence omitted]

SEQ ID NO: 1175 - protein, 1193 aa, Homo sapiens
MWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKTLLSIPEVVRGCKELQGLLEFLS

SEQ ID NO: 1176 - protein, 2715 aa, Homo sapiens
MAAAAGGGSCPGPGSARGRFPGRPRGAGGGGGRGGRGNGAERVRVALRRGGGATGPGGAEPGEDTALLRLLGLRRGLRRLRRLWAGPRVQRGRGRGRGRGWGPSRGCVPEEESSDGESDEEEFQGFHSDEDVAPSSLRSALRSQRGRAPRGRGRKHKTTPLPPPRLADVAPTPPKTPARKRGEEGTERMVQALTELLRRAQAPQAPRSRACEPSTPRRSRGRPPGRPAGPCRRKQQAVVVAEAAVTIPKPEPPPPVVPVKHQTGSWKCKEGPGPGPGTPRRGGQSSRGGRGGRGRGRGGGLPFVIKFVSRAKKVKMGQLSLGLESGQGQGQHEESWQDVPQRRVGSGQGGSPCWKKQEQKLDDEEEEKKEEEEKDKEGEEKEERAVAEEMMPAAEKEEAKLPPPPLTPPAPSPPPPLPPPSTSPPPPLCPPPPPPVSPPPLPSPPPPPAQEEQEESPPPVVPATCSRKRGRPPLTPSQRAEREAARAGPEGTSPPTPTPSTATGGPPEDSPTVAPKSTTFLKNIRQFIMPVVSARSSRVIKTPRRFMDEDPPKPPKVEVSPVLRPPITTSPPVPQEPAPVPSPPRAPTPPSTPVPLPEKRRSILREPTFRWTSLTRELPPPPPAPPPPPAPSPPPAPATSSRRPLLLRAPQFTPSEAHLKIYESVLTPPPLGAPEAPEPEPPPADDSPAEPEPRAVGRTNHLSLPRFAPVVTTPVKAEVSPHGAPALSNGPQTQAQLLQPLQALQTQLLPQALPPPQPQLQPPPSPQQMPPLEKARIAGVGSLPLSGVEEKMFSLLKRAKVQLFKIDQQQQQKVAASMPLSPGGQMEEVAGAVKQISDRGPVRSEDESVEAKRERPSGPESPVQGPRIKHVCRHAAVALGQARAMVPEDVPRLSALPLRDRQDLATEDTSSASETESVPSRSRRGKVEAAGPGGESEPTGSGGTLAHTPRRSLPSHHGKKMRMARCGHCRGCLRVQDCGSCVNCLDKPKFGGPNTKKQCCVYRKCDKIEARKMERLAKKGRTIVKTLLPWDSDESPEASPGPPGPRRGAGAGGPREEVVAHPGPEEQDSLLQRKSARRCVKQRPSYDIFEDSDDSEPGGPPAPRRRTPRENELPLPEPEEQSRPRKPTLQPVLQLKARRRLDKDALAPGPFASFPNGWTGKQKSPDGVHRVRVDFKEDCDLENVWLMGGLSVLTSVPGGPPMVCLLCASKGLHELVFCQVCCDPFHPFCLEEAERPLPQHHDTWCCRRCKFCHVCGRKGRGSKHLLECERCRHAYHPACLGPSYPTRATRKRRHWICSACVRCKSCGATPGKNWDVEWSGDYSLCPRCTQLYEKGNYCPICTRCYEDNDYESKMMQCAQCDHWVHAKCEGLSDEDYEILSGLPDSVLYTCGPCAGAAQPRWREALSGALQGGLRQVLQGLLSSKVVGPLLLCTQCGPDGKQLHPGPCGLQAVSQRFEDGHYKSVHSFMEDMVGILMRHSEEGETPDRRAGGQMKGLLLKLLESAFGWFDAHDPKYWRRSTRLPNGVLPNAVLPPSLDHVYAQWRQQEPETPESGQPPGDPSAAFQGKDPAAFSHLEDPRQCALCLKYGDADSKEAGRLLYIGQNEWTHVNCAIWSAEVFEENDGSLKNVHAAVARGRQMRCELCLKPGATVGCCLSSCLSNFHFMCARASYCIFQDDKKVFCQKHTDLLDGKEIVNPDGFDVLRRVYVDFEGINFKRKFLTGLEPDAINVLIGSIRIDSLGTLSDLSDCEGRLFPIGYQCSRLYWSTVDARRRCWYRCRILEYRPWGPREEPAHLEAAEENQTIVHSPAPSSEPPGGEDPPLDTDVLVPGAPERHSPIQNLDPPLRPDSGSAPPPAPRSFSGARIKVPNYSPSRRPLGGVSFGPLPSPGSPSSLTHHIPTVGDPDFPAPPRRSRRPSPLAPRPPPSRWASPPLKTSPQLRVPPPTSVVTALTPTSGELAPPGPAPSPPPPEDLGPDFEDMEVVSGLSAADLDFAASLLGTEPFQEEIVAAGAMGSSHGGPGDSSEEESSPTSRYIHFPVTVVSAPGLAPSATPGAPRIEQLDGVDDGTDSEAEAVQQPRGQGTPPSGPGVVRAGVLGAAGDRARPPEDLPSEIVDFVLKNLGGPGDGGAGPREESLPPAPPLANGSQPSQGLTASPADPTRTFAWLPGAPGVRVLSLGPAPEPPKPATSKIILVNKLGQVFVKMAGEGEPVPPPVKQPPLPPTISPTAPTSWTLPPGPLLGVLPVVGVVRPAPPPPPPPLTLVLSSGPASPPRQAIRVKRVSTFSGRSPPAPPPYKAPRLDEDGEASEDTPQVPGLGSGGFSRVRMKTPTVRGVLDLDRPGEPAGEESPGPLQERSPLLPLPEDGPPQVPDGPPDLLLESQWHHYSGEASSSEEEPPSPDDKENQAPKRTGPHLRFEISSEDGFSVEAESLEGAWRTLIEKVQEARGHARLRHLSFSGMSGARLLGIHHDAVIFLAEQLPGAQRCQHYKFRYHQQGEGQEEPPLNPHGAARAEVYLRKCTFDMFNFLASQHRVLPEGATCDEEEDEVQLRSTRRATSLELPMAMRFRHLKKTSKEAVGVYRSAIHGRGLFCKRNIDAGEMVIEYSGIVIRSVLTDKREKFYDGKGIGCYMFRMDDFDVVDATMHGNAARFINHSCEPNCFSRVIHVEGQKHIVIFALRRILRGEELTYDYKFPIEDASNKLPCNCGAKRCRRFLN

SEQ ID NO: 1177 - protein, 1003 aa, Homo sapiens
MPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKVFLEFCKENGGYTGCPFPAKLDLQQGQNLLQGLSKLSPSTSGPHSHDYLPQEREGEGGLSLQVEPEWRNEL

SEQ ID NO: 1178 - protein, 376 aa, Homo sapiens
RPMPRLEPTFEIDEEEEEEDENELFPREYFRRLSSQDVLRCQSSSKRKSKDEEEDEESDDADDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIAT

SEQ ID NO: 1179 - protein, 114 aa, Homo sapiens
MTCKMSQLERNIETIINTFHQYSVKLGHPDTLNQGEFKELVRKDLQNFLKKENKNEKVIEHIMEDLDTNADKQLSFEEFIMLMARLTWASHEKMHEGDEGPGHHHKPGLGEGTP

SEQ ID NO: 1180 - protein, 5179 aa, Homo sapiens
MGLPLARLAAVCLALSLAGGSELQTEGRTRYHGRNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALEGGSHITTFDGKTYTFHGDCYYVLAKGDHNDSYALLGELAPCGSTDKQTCLKTVVLLADKKKNAVVFKSDGSVLLNQLQVNLPHVTASFSVFRPSSYHIMVSMAIGVRLQVQLAPVMQLFVTLDQASQGQVQGLCGNFNGLEGDDFKTASGLVEATGAGFANTWKAQSTCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTSFTTTTTTTTPTSSTVLSTTPKLCCLWSDWINEDHPSSGSDDGDREPFDGVCGAPEDIECRSVKDPHLSLEQHGQKVQCDVSVGFICKNEDQFGNGPFGLCYDYKIRVNCCWPMDKCITTPSPPTTTPSPPPTTTTTLPPTTTPSPPTTTTTTPPPTTTPSPPITTTTTPLPTTTPSPPISTTTTPPPTTTPSPPTTTPSPPTTTPSPPTTTTTTPPPTTTPSPPMTTPITPPASTTTLPPTTTPSPPTTTTTTPPPTTTPSPPTTTPITPPTSTTTLPPTTTPSPPPTTTTTPPPTTTPSPPTTTTPSPPTITTTTPPPTTTPSPPTTTTTTPPPTTTPSPPTTTPITPPTSTTTLPPTTTPSPPPTTTTTPPPTTTPSPPTTTTPSPPITTTTTPPPTTTPSSPITTTPSPPTTTMTTPSPTTTPSSPITTTTTPSSTTTPSPPPTTMTTPSPTTTPSPPTTTMTTLPPTTTSSPLTTTPLPPSITPPTFSPFSTTTPTTPCVPLCNWTGWLDSGKPNFHKPGGDTELIGDVCGPGWAANISCRATMYPDVPIGQLGQTVVCDVSVGLICKNEDQKPGGVIPMAFCLNYEINVQCCECVTQPTTMTTTTTENPTPPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCVKIHNQLISSVSNITCPNFDASICIPGSITFMPNGCCKTCTPRNETRVPCSTVPVTTEVSYAGCTKTVLMNHCSGSCGTFVMYSAKAQALDHSCSCCKEEKTSQREVVLSCPNGGSLTHTYTHIESCQCQDTVCGLPTGTSRRARRSPRHLGSG

SEQ ID NO: 1181 - protein, 5703 aa, Homo sapiens
MGAPSACRTLVLALAAMLVVPQAETQGPVEPSWGNAGHTMDGGAPTSSPTRRVSFVPPVTVFPSLSPLNPAHNGRVCSTWGDFHYKTFDGDVFRFPGLCNYVFSEHCRAAYEDFNVQLRRGLVGSRPVVTRVVIKAQGLVLEASNGSVLINGQREELPYSRTGLLVEQSGDYIKVSIRLVLTFLWNGEDSALLELDPKYANQTCGLCGDFNGLPAFNEFYAHNARLTPLQFGNLQKLDGPTEQCPDPLPLPAGNCTDEEGICHRTLLGPAFAECHALVDSTAYLAACAQDLCRCPTCPCATFVEYSRQCAHAGGQPRNWRCPELCPRTCPLNMQHQECGSPCTDTCSNPQRAQLCEDHCVDGCFCPPGSTVLDDITHSGCLPLGQCPCTHGGRTYSPGTSFNTTCSSCTCSGGLWQCQDLPCPGTCSVQGGAHISTYDEKLYDLHGDCSYVLSKKCADSSFTVLAELRKCGLTDNENCLKAVTLSLDGGDTAIRVQADGGVFLNSIYTQLPLSAANITLFTPSSFFIVVQTGLGLQLLVQLVPLMQVFVRLDPAHQGQMCGLCGNFNQNQADDFTALSGVVEATGAAFANTWKAQAACANARNSFEDPCSLSVENENYARHWCSRLTDPNSAFSRCHSIINPKPFHSNCMFDTCNCERSEDCLCAALSSYVHACAAKGVQLSDWRDGVCTKYMQNCPKSQRYAYVVDACQPTCRGLSEADVTCSVSFVPVDGCTCPAGTFLNDAGACVPAQECPCYAHGTVLAPGEVVHDEGAVCSCTGGKLSCLGASLQKSTGCAAPMVYLDCSNSSAGTPGAECLRSCHTLDVGCFSTHCVSGCVCPPGLVSDGSGGCIAEEDCPCVHNEATYKPGETIRVDCNTCTCRNRRWECSHRLCLGTCVAYGDGHFITFDGDRYSFEGSCEYILAQDYCGDNTTHGTFRIVTENIPCGTTGTTCSKAIKLFVESYELILQEGTFKAVARGPGGDPPYKIRYMGIFLVIETHGMAVSWDRKTSVFIRLHQDYKGRVCGLCGNFDDNAINDFATRSRSVVGDALEFGNSWKLSPSCPDALAPKDPCTANPFRKSWAQKQCSILHGPTFAACRSQVDSTKYYEACVNDACACDSGGDCECFCTAVAAYAQACHDAGLCVSWRTPDTCPLFCDFYNPHGGCEWHYQPCGAPCLKTCRNPSGHCLVDLPGLEGCYPKCPPSQPFFNEDQMKCVAQCGCYDKDGNYYDVGARVPTAENCQSCNCTPSGIQCAHSLEACTCTYEDRTYSYQDVIYNTTDGLGACLIAICGSNGTIIRKAVACPGTPATTPFTFTTAWVPHSTTSPALPVSTVCVREVCRWSSWYNGHRPEPGLGGGDFETFENLRQRGYQVCPVLADIECRAAQLPDMPLEELGQQVDCDRMRGLMCANSQQSPPLCHDYELRVLCCEYVPCGPSPAPGTSPQPSLSASTEPAVPTPTQTTATEKTTLWVTPSIRSTAALTSQTGSSSGPVTVTPSAPGTTTCQPRCQWTEWFDEDYPKSEQLGGDVESYDKIRAAGGHLCQQPKDIECQAESFPNWTLAQVGQKVHCDVHFGLVCRNWEQEGVFKMCYNYRIRVLCCSDDHCRGRATTPPPTTELETATTTTTQALFSTPQPTSSPGLTRAPPASTTAVPTLSEGLTSPRYTSTLGTATTGGPRQSAGSTEPTVPGVATSTLPTRSALPGTTGSLGTWRPSQPPTLAPTTMATSRARPTGTASTASKEPLTTSLAPTLTSELSTSQAETSTPRTETTMSPLTNTTTSQGTTRCQPKCEWTEWFDVDFPTSGVASGDMETFENIRAAGGKMCWAPKSIECRAENYPEVSIDQVGQVLTCSLETGLTCKNEDQTGRFNMCFNYNVRVLCCDDYSHCPSTLATSSTATPSSTPGTTWILTKPTTTATTTASTGSTATASSTQATAGTPHVSTTATTPTVTSSKATPFSSPGTATALPALRSTATTPTATSFTAIPSSSLGTTWTRLSQTTTPMATMSTATPSSTPETVHTSTVLTTTATTTGATGSVATPSSTPGTAHTTKVLTTTTTGFTATPSSSPGRARTLPVWISTTTTPTTRGSTVTPSSIPGTTHTPTVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLSPSSPHTVCTAWTSATSGILGTTHITEPSTGTSHTPAATTGTTQHSTPALSSPHPSSRTTESPPSPGTTTPGHTTATSRTTATATPSKTRTSTLLPSQPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTELTTTATTTESTGSTATPTSTLRTAPPPKVLTTTATTPTVTSSKATPSSSPGTATALPALRSTATTPTATSVTPIPSSSLGTTWTRLSQTTTPTATMSTATPSSTPETAHTSTVLTATATTTGATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTRPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTTATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTEQTTAATTTATTGSTAIPSSTPGTAPPPKVLTSQATTPTATSSKATSSSSPRTATTLPVLTSTATKSTATSFTPIPSSTLGTTGTSQNRPPHPMATMSTIHPSSTPETTHTSTVLTTKATTTRATSSMSTPSSTPGTTWILTELTTAATTTAALPHGTPSSTPGTTWILTEPSTTATVTVPTGSTATASSTRATAGTLKVLTSTATTPTVISSRATPSSSPGTATALPALRSTATTPTATSVTAIPSSSLGTAWTRLSQTTTPTATMSTATPSSTPETVHTSTVLTTTATTTRTGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLPPSSPHTVPTAWTSATSGILGTTHITEPSTGTSHTPAATTGTTQPSTPALSSPHPSSRTTESPPSPGTTTPGHTRGTSRTTATATPSKTRTSTLLPSSPTSAPITTVVTTGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTKLTTTATTTESTGSTATPSSTQGPPAGTPHVSTTATTPTVTSSKATPFSSPGTATALPALRSTATTPTATSFTAIPSSSLGTTWTRLSQTTTPMATMSTATPSSTPETVHTSTVLTTTATTTGATGSVATPSSTPGTAHTTKVPTTTTTGFTVTPSSSPGTARTPPVWISTTTTPTTSGSTVTPSSIPGTTHTPTVLTTTTQPVATGSMATPSSSTQTSGTPPSLITTATTITATGSTTNPSSTPGTTPIPPELTTTATTPAATSSTVTPSSALGTTHTPPVPNTTATTHGRSLSPSSPHTVRTAWTSATSGTLGTTHITEPSTGTSHTPAATTGTTTTSTPALSSPHPSSRTTESPPSPGTTTPGHTTATSRTTATATPSKTRTSTLLPSQPTSAPITTVVTTGCEPQCAWSEWLDYSYPMPGPSGGDFDTYSNIRAAGGAVCEQPLGLECRAQAQPGVPLGELGQVVECSLDFGLVCRNREQVGKFKMCFNYEIRVFCCNYGHCPSTPATSSTAMPSSTPGTTWILTELTTTATTTASTGSTATPSSTPGTAPPPKVLTSPATTPTATSSKATSSSSPRTATTLPVLTSTATKSTATSVTPIPSSTLGTTGTLPEQTTTPVATMSTIHPSSTPETTHTSTVLTTKATTRATSSTSTPSSTPGTTWILTELTTAATTTAGTGPTATPSSTPGTTWILTELTTTATTTASTGSTATLSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTTTATTTGATGSVATPSSTPGTAHTTKVPTTTTTGFTATPSSSPGTALTPPVWISTTTTPTTTTPTTSGSTVTPSSIPGTTHTARVLTTTTTTVATGSMATPSSSTQTSGTPPSLTTTATTITATGSTTNPSSTPGTTPIPPVLTSMATTPAATSSKATSSSSPRTATTLPVLTSTATKSTATSFTPIPSSTLWTTWTVPAQTTTPMSTMSTIHTSSTPETTHTSTVLTTTATMTRATNSTATPSSTLGTTRILTELTTTATTTAATGSTATLSSTPGTTWILTEPSTIATVMVPTGSTATTSSTLGTAHTPKVVTAMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVTVTFNGQVFQARLPYSLFHNNTEGQCGTCTNNQRDDCLQRDGTTAASCKDMAKTWLVPDSRKDGCWAPTGTPPTASPAAPVSSTPTPTPCPPQPLCDLMLSQVFAECHNLVPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMAPPHTRGFPAQEATAV

SEQ ID NO: 1182 - protein, 2042 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 1183 - protein, 403 aa, Homo sapiens
MATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLNEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQSDNDLLTQTRTIAMSLVKCASSDTQDQYKLVKDISF

SEQ ID NO: 1184 - protein, 1463 aa, Homo sapiens [sequence omitted]

SEQ ID NO: 1185 - protein, 181 aa, Homo sapiens
MFKKFDEKENVSNCIQLKTSVIKGIKNQLIEQFPGIEPWLNQIMPKKDPVKIVRCHEHIEILTVNGELLFFRQREGPFYPTLRLLHKYPFILPHQQVDKGAIKFVLSGANIMCPGLTSPGAKLYPAAVDTIVAIMAEGKQHALCVGVMKMSAEDIEKVNKGIGIENIHYLNDGLWHMKTYK

SEQ ID NO: 1186 - protein, 1137 aa, Homo sapiens
MSRRKPASGGLAASSSAPARQAVLSRFFQSTGSLKSTSSSTGAADQVDPGAAAAAAAAAAAAPPAPPAPAFPPQLPPHVATEIDRRKKRPLENDGPVKKKVKKVQQKEGGSDLGMSGNSEPKKCLRTRNVSKSLEKLKEFCCDSALPQSRVQTESLQERFAVLPKCTDFDDISLLHAKNAVSSEDSKRQINQKDTTLFDLSQFGSSNTSHENLQKTASKSANKRSKSIYTPLELQYIEMKQQHKDAVLCVECGYKYRFFGEDAEIAARELNIYCHLDHNFMTASIPTHRLFVHVRRLVAKGYKVGVVKQTETAALKAIGDNRSSLFSRKLTALYTKSTLIGEDVNPLIKLDDAVNVDEIMTDTSTSYLLCISENKENVRDKKKGNIFIGIVGVQPATGEVVFDSFQDSASRSELETRMSSLQPVELLLPSALSEQTEALIHRATSVSVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGRSTFMEELTDTAEIIRKATSQSLVILDELGRGTSTHDGIAIAYATLEYFIRDVKSLTLFVTHYPPVCELEKNYSHQVGNYHMGFLVSEDESKLDPGTAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 1187 - protein, 604 aa, Homo sapiens
MAKESGISLKEIQVLARQWKVGPEKRVPAMPGSPVEVKIQSRSSPPTMPPLPPINPGGPRPVSFTPTALSNGINHSPPTLNGAPSPPQRFSNGPASSTSSALTNQQLPATCGARQLSKLKRFLTTLQQFGNDISPEIGEKVRTLVLALVNSTVTIEEFHCKLQEATNFPLRPFVIPFLKANLPLLQRELLHCARAAKQTPSQYLAQHEHLLLNTSIASPADSSELLMEVHGNGKRPSPERREENSFDRDTIAPEPPAKRVCTISPAPRHSPALTVPLMNPGGQFHPTPPPLQHYTLEDIATSHLYREPNKMLEHREVRDRHHSLGLNGGYQDELVDHRLTEREWADEWKHLDHALNCIMEMVEKTRRSMAVLRRCQESDREELNYWKRRYNENTELRKTGTELVSRQHSPGSADSLSNDSQREFNSRPGTGYVPVEFWKKTEEAVNKVKIQAMSEVQKAVAEAEQKAFEVIATERARMEQTIADVKRQAAEDAFLVINEQEESTENCWNCGRKASETCSGCNIARYCGSFCQHKDWERHHRLCGQNLHGQSPHGQGRPLLPVGRGSSARSADCSVPSPALDKTSATTSRSSTPASVTAIDTNGL

SEQ ID NO: 1188 - protein, 1451 aa, Homo sapiens
MVPIFSGRQKHVSGITDTEEERIKEAAAYIAQRNLLASEEGITTPKQSTASKQTTASKQSTASKQSTASKQSTASRQSTASRQSVVSKQATSALQQEETSEKKSRKVVIRGKAERLSLRKTLEETETYHAKLNEDHLLHAPEFIIKPRSHTVWEKENVKLHCSIAGWPEPRVTWYKNQVPINVHANPGKYIIESRYGMHTLEINACDFEDTAQYRASAMNVKGELSAYASVVVKRYKGEFDETRFHAGASTMPLSFGVTPYGYASRFEIHFDDKFDVSFGREGETMSLGCRVVITPEIKHFQPEIRWYRNGVPLSPSKWVQTLWSGERATLTFSHLNKEDEGLYTIRVRMGEYYEQYSAYVFVRDADAEIEGAPAAPLDVKCLEANKDYIIISWKQPAVDGGSPILGYFIDKCEVGTDSWSQCNDTPVKFARFPVTGLIEGRSYIFRVRAVNKMGIGFPSRVSEAVAALDPAEKARLKSPLSTLDWTVIVTEEEPSEGIVPGPPTDLSVTEATRSYVVLSWKPPGQRGHEGIMYFVEKCEAGTENWQRVNTELPVKSPRFALFDLAEGKSYCFRVRCSNSAGVGEPSEATEVTVVGDKLDIPKAPGKIIPSRNTDTSVVVSWEESKDAKELVGYYIEANVAGSGKWEPCNNNPVKTHRFTCHGLVTGQSYIFRVRAVNAAGLSEYSQDSEAIEVKAAIAPPSPPCDITCLESFRDSMVLGWKQPDKTGGAEITGYYVNYREVIDGVPGKWREANVKAVREEAYKISNLKENMVYQFQVAAMNMAGLGAPSAVSECFKCEEWTIAVPGPPHSLKCSEVRKDSLVLQWKPPVHSGRTPVTGYFVDLKEKAKEDQWRGLNEAAIKNVYLKVRGLKEGVSYVFRVRAINQAGVGKPSDLAGPVVAETRPGRKEVVVNVDDDGVISLNFECDKMTPKSEFSWSKDYVSTEDSPRLEVESKGNKTKMTFKDLGMDDLGIYSCDVTDTDGIASSYLIDEEELKRLLALSHEHKFPTVPVKSELAVEILEKGQVRFWMQAEKLSGNAKVNYIFNEKEIFEGPKYKMHIDRNTGIIEMFMEKLQDEDEGTYTFQLQDGKATNHSTVVLVGDVFKKLQKEAEFQRQEWIRKQGPHFVEYLSWEVTGECNVLLKCKVANIKKETHIVWYKDEREISVDEKHDFKDGICTLLITEFSKKDAGIYEVILKDDRGKDKSRLKLVDEAFKELMMEVCKKIALSATDLKIQSTAEGIQLYSFVTYYVEDLKVNWSHNGSAIRYSDRVKTGVTGEQIWLQINEPTPNDKGKYVMELFDGKTGHQKTVDLSGQAYDEAYAEFQRLKQAAIAEKNRARVLGGLPDVVTIQEGKALNLTCNVWGDPPPEVSWLKNEKALAQTDHCNLKFEAGRTAYFTINGVSTADSGKYGLVVKNKYGSETSDFTVSVFIPEEEARMAALESLKGGKKAK

SEQ ID NO: 1189 - protein, 1935 aa, Homo sapiens
MGDSEMAVFGAAAPYLRKSEKERLEAQTRPFDLKKDVFVPDDKQEFVKAKIVSREGGKVTAETEYGKTVTVKEDQVMQQNPPKFDKIEDMAMLTFLHEPAVLYNLKDRYGSWMIYTYSGLFCVTVNPYKWLPVYTPEVVAAYRGKKRSEAPPHIFSISDNAYQYMLTDRENQSILITGESGAGKTVNTKRVIQYFAVIAAIGDRSKKDQSPGKGTLEDQIIQANPALEAFGNAKTVRNDNSSRFGKFIRIHFGATGKLASADIETYLLEKSRVIFQLKAERDYHIFYQILSNKKPELLDMLLITNNPYDYAFISQGETTVASIDDAEELMATDNAFDVLGFTSEEKNSMYKLTGAIMHFGNMKFKLKQREEQAEPDGTEEADKSAYLMGLNSADLLKGLCHPRVKVGNEYVTKGQNVQQVIYATGALAKAVYERMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLFDNHLGKSANFQKPRNIKGKPEAHFSLIHYAGIVDYNIIGWLQKNKDPLNETVVGLYQKSSLKLLSTLFANYAGADAPIEKGKGKAKKGSSFQTVSALHRENLNKLMTNLRSTHPHFVRCIIPNETKSPGVMDNPLVMHQLRCNGVLEGIRICRKGFPNRILYGDFRQRYRILNPAAIPEGQFIDSRKGAEKLLSSLDIDHNQYKFGHTKVFFKAGLLGLLEEMRDERLSRIITRIQAQSRGVLARMEYKKLLERRDSLLVIQWNIRAFMGVKNWPWMKLYFKIKPLLKSAEREKEMASMKEEFTRLKEALEKSEARRKELEEKMVSLLQEKNDLQLQVQAEQDNLADAEERCDQLIKNKIQLEAKVKEMNERLEDEEEMNAELTAKKRKLEDECSELKRDIDDLELTLAKVEKEKHATENKVKNLTEEMAGLDEIIAKLTKEKKALQEAHQQALDDLQAEEDKVNTLTKAKVKLEQQVDDLEGSLEQEKKVRMDLERAKRKLEGDLKLTQESIMDLENDKQQLDERLKKKDFELNALNARIEDEQALGSQLQKKLKELQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKMCRTLEDQMNEHRSKAEETQRSVNDLTSQRAKLQTENGELSRQLDEKEALISQLTRGKLTYTQQLEDLKRQLEEEVKAKNALAHALQSARHDCDLLREQYEEETEAKAELQRVLSKANSEVAQWRTKYETDAIQRTEELEEAKKKLAQRLQEAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGSSGKTIHELEKVRKQLEAEKMELQSALEEAEASLEHEEGKILRAQLEFNQIKAEIERKLAEKDEEMEQAKRNHLRVVDSLQTSLDAETRSRNEALRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMDADLSQLQTEVEEAVQECRNAEEKAKKAITDAAMMAEELKKEQDTSAHLERMKKNMEQTIKDLQHRLDEAEQIALKGGKKQLQKLEARVRELENELEAEQKRNAESVKGMRKSERRIKELTYQTEEDRKNLLRLQDLVDKLQLKVKAYKRQAEEAEEQANTNLSKFRKVQHELDEAEERADIAESQVNKLRAKSRDIGTKGLNEE

SEQ ID NO: 1190 - protein, 1938 aa, Homo sapiens
MSSDAEMAIFGEAAPYLRKPEKERIEAQNRPFDSKKACFVADNKEMYVKGMIQTRENDKVIVKTLDDRMLTLNNDQVFPMNPPKFDKIEDMAMMTHLHEPAVLYNLKERYAAWMIYTYSGLFCVTVNPYKWLPVYKPEVVAAYRGKKRQEAPPHIFSISDNAYQFMLTDRDNQSILITGESGAGKTVNTKRVIQYFATIAVTGDKKKETQPGKMQGTLEDQIIQANPLLEAFGNAKTVRNDNSSRFGKFIRIHFGATGKLASADIETYLLEKSRVTFQLSSERSYHIFYQIMSNKKPELIDLLLISTNPFDFPFVSQGEVTVASIDDSEELLATDNAIDILGFSSEEKVGIYKLTGAVMHYGNMKFKQKQREEQAEPDGTEVADKAGYLMGLNSAEMLKGLCCPRVKVGNEYVTKGQNVQQVTNSVGALAKAVYEKMFLWMVTRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYDQHLGKSNNFQKPKPAKGKAEAHFSLVHYAGTVDYNIAGWLDKNKDPLNETVVGLYQKSSLKLLSFLFSNYAGAETGDSGGSKKGGKKKGSSFQTVSAVFRENLNKLMTNLRSTHPHFVRCLIPNETKTPGVMDHYLVMHQLRCNGVLEGIRICRKGFPSRILYADFKQRYRILNASAIPEGQFIDSKNASEKLLNSIDVDREQFRFGNTKVFFKAGLLGLLEEMRDEKLVTLMTSTQAVCRGYLMRVEFKKMMERRDSIFCIQYNIRSFMNVKHWPWMNLFFKIKPLLKSAEAEKEMATMKEDFERTKEELARSEARRKELEEKMVSLLQEKNDLQLQVQSETENLMDAEERCEGLIKSKILLEAKVKELTERLEEEEEMNSELVAKKRNLEDKCSSLKRDIDDLELTLTKVEKEKHATENKVKNLSEEMTALEENISKLTKEKKSLQEAHQQTLDDLQVEEDKVNGLIKINAKLEQQTDDLEGSLEQEKKLRADLERAKRKLEGDLKMSQESIMDLENEKQQIEEKLKKKEFELSQLQARIDDEQVHSLQFQKKIKELQARIEELEEEIEAEHTLRAKIEKQRSDLARELEEISERLEEASGATSAQIEMNKKREAEFQKMRRDLEEATLQHEATAATLRKKQADSVAELGEQIDNLQRVKQKLEKEKSELKMEIDDMASNIEALSKSKSNIERTCRTVEDQFSEIKAKDEQQTQLIHDLNMQKARLQTQNGELSHRVEEKESLISQLTKSKQALTQQLEELKRQMEEETKAKNAMAHALQSSRHDCDLLREQYEEEQEAKAELQRALSKANSEVAQWKTKYETDAIQRTEELEEAKKKLAQRLQEAEEKTETANSKCASLEKTKQRLQGEVEDLMRDLERSHTACATLDKKQRNFDKVLAEWKQKLDESQAELEAAQKESRSLSTELFKMRNAYEEVVDQLETLRRENKNLQEEISDLTEQIAETGKNLQEAEKTKKLVEQEKSDLQVALEEVEGSLEHEESKILRVQLELSQVKSELDRKVIEKDEEIEQLKRNSQRAAEALQSVLDAEIRSRNDALRLKKKMEGDLNEMEIQLGHSNRQMAETQRHLRTVQGQLKDSQLHLDDALRSNEDLKEQLAIVERRNGLLLEELEEMKVALEQTERTRRLSEQELLDASDRVQLLHSQNTSLINTKKKLEADIAQCQAEVENSIQESRNAEEKAKKAITDAAMMAEELKKEQDTSAHLERMKKNLEQTVKDLQHRLDEAEQLALKGGKKQIQKLENRVRELENELDVEQKRGAEALKGAHKYERKVKEMTYQAEEDRKNILRLQDLVDKLQAKVKSYKRQAEEAEEQANTQLSRCRRVQHELEEAAERADIAESQVNKLRAKSRDVGSQKMEE

SEQ ID NO: 1191 - protein, 348 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSDLDFE

SEQ ID NO: 1192 - protein, 1695 aa, Homo sapiens
MNVQPCSRCGYGVYPAEKISCIDQIWHKACFHCEVCKMMLSVNNFVSHQKKPYCHAHNPKNNTFTSVYHTPLNLNVRTFPEAISGIHDQEDGEQCKSVFHWDMKSKDKEGAPNRQPLANERAYWTGYGEGNAWCPGALPDPEIVRMVEARKSLGEEYTEDYEQPRGKGSFPAMITPAYQRAKKANQLASQVEYKRGHDERISRFSTVADTPELLRSKAGAQLQSDVRYTEDYEQQRGKGSFPAMITPAYQIAKRANELASDVRYHQQYQKEMRGMAGPAIGAEGILTRECADQYGQGYPEEYEEHRGKGSFPAMITPAYQNAKKAHELASDIKYRQDFNKMKGTAHYHSLPAQDNLVLKRAQSVNKLVSENKYKENYQNHMRGRYEGVGMDRRTLHAMKVGSLASNVAYKADYKHDIVDYNYPATLTPSYQTAMKLVPLKDANYRQSIDKLKYSSVTDTPQIVQAKINAQQLSHVNYRADYEKNKLNYTLPQDVPQLVKAKTNAKLFSEVKYKEGWEKTKGKGFEMKLDAMSLLAAKASGELASNIKYKEEYEKTKGKAMGTADSRLLHSLQIAKMSSEVEYKKGFEESKTRFHLPMDMVNIRHAKKAQTLASDLDYRKKLHEYTVLPEDMKTQWAKKVYGLQSELQYKADLAWMKGVGWLTEGSLNLEQAKKAGQLVSEKNYRQRVDELKFTSVTDSSQMEHAKKSQELQSGVAYKAGNEQSVHQYTISKDEPLFLQARANAANLSEKLYKSSWENQKAKGFELRLDSLTFLAAKAKRDLASEVKYKEDYERSRGKLIGAKDVQGDSQMSHSLQMSKLQSELEYKKGFEDTKSQCHVSLDMVHLVHARKAQHLATDVGYKTAEHHFTALPTDMKVEWAKKAYGLQSDNQYRADVKWMKGMGWVATGSLNVEQAKKAGELISEKKYRQHPDALKFTSIKDTPEMVQARISYTQAVDRLYREQGENIKHHYTPTADLPEVLLAKLNAMNISETRYKESWSKLRDGGYKLRLDALPFQAAKASGEIISDYKYKEAFEKMKGQMLGSRSLEDDISLAHSVYATSLQSDVNYKKGFEHSKAQFHLPLDMAALVHAKKAQTLASNQDYKHPLPQYTSLAEDLRLSCAKKAHKLQSENLYRSDLNFMRGVACVIPGTLEIEGRKKASELISESKYRQHPHSFKYTAVTDTPNLLHAKFSNQITNERLYKAAGEDARHEYTMTLGLPEFIRAKTNAANLSDARYKESWRNLRAQGYKLTIEALPFQAARASGDIASDFLYRHDFVKERGKLIGPQSVRDDPRIQHCRRMGQLQSELQYRRGATSSQAQFHLPMDMVHLVHAKNAQALASDHDYRTQYHKFTALPEDLKMAWAKKAHALQSELRYKSDLIGMKGIGWLALRSPQMESAKKAGELISETKYRKKPDSIKFTTVVDSPDLVHAKNSYMHCNERMYRSGDAESLHRYTLIPDHPDFTRARLNALHLSDKVYRNSWEQTRAGSYDFRLDAIPFQTARASREIASDFRYKEAFLRDRGLQIGYRSVDDDPRMKHFLNVGRLQSDNEYKKDFAKSRSQFHSSTDQPGLLQAKRSQQLASDVHYRQPLPQPTCDPEQLGLRHAQKAHQLQSDVKYKSDLNLTRGVGWTPPGSYKVEMARRAAELANARGLGLQGAYRGAEAVEAGDHQSGEVNPDATEILHVKKKKALLL

SEQ ID NO: 1193 - protein, 761 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVHSPPPPASASSSTPVPLSPPDTTWPLPALATTEPAKGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 1194 - protein, 344 aa, Homo sapiens
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 1195 - protein, 2090 aa, Homo sapiens
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEPFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEELNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQVSLPGHLCSPTSHSSFNSSFTSLYCH

SEQ ID NO: 1196 - protein, 2471 aa, Homo sapiens
MPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 1197 - protein, 2556 aa, Homo sapiens
  misc_feature (891)..(891): Xaa can be any naturally occurring amino acid
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPRLCRHGGTCHNEVGSYRCVCRATHTGPNCERPYVPCSPSPCQNGGTCRPTGDVTHECACLPGFTGQNCEENIDDCPGNNCKNGGACVDGVNTYNCPCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCMCMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRLRGTCQDPDNAYLCFCLKGTTGPNCEINLDDCASSPCDSGTCLDKIDGYECACEPGYTGSMCNSNIDECAGNPCHNGGTCEDGINGFTCRCPEGYHDPTCLSEVNECNSNPCVHGACRDSLNGYKCDCDPGWSGTNCDINNNECESNPCVNGGTCKDMTSGIVCTCREGFSGPNCQTNINECASNPCLNKGTCIDDVAGYKCNCLLPYTGATCEVVLAPCAPSPCRNGGECRQSEDYESFSCVCPTAGAKGQTCEVDINECVLSPCRHGASCQNTHGXYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHVVNECDSRPCLLGGTCQDGRGLHRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 1198 - protein, 2321 aa, Homo sapiens
MGPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPVAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 1199 - protein, 2003 aa, Homo sapiens
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 1200 - protein, 1896 aa, Homo sapiens
MPLPPRSLQVLLLLLLLLLLLPGMWAEAGLPRAGGGSQPPFRTFSGSDWGLTHLLVHEQTGEVYVGAVNRIYKLSGNLTLLRAHVTGPVEDNEKCYPPPSVQSCPHGLGNTDNVNKLLLLDYAANRLLACGSASQGICQSLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFRGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYLKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAADTPASWMHARHGSSRCTDPKILKLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLPAIVGIGGGGGLLLLVIVAVLIAYKRKSRDADRTLKRLQLQMDNLESRVALECKEAFAELQTDIHELTNDLDGAGIPFLDYRTYAMRVLFPGIEDHPVLKEMEVQANVEKSLTLFGQLLTKKHFLLTFIRTLEAQRSFSMRDRGNVASLIMTALQGEMEYATGVLKQLLSDLIEKNLESKNHPKLLLRRTESVAEKMLTNWFTFLLYKFLKECAGEPLFMLYCAIKQQMEKGPIDAITGEARYSLSEDKLIRQQIDYKTLTLNCVNPENENAPEVPVKGLDCDTVTQAKEKLLDAAYKGVPYSQRPKAADMDLEWRQGRMARIILQDEDVTTKIDNDWKRLNTLAHYQVTDGSSVALVPKQTSAYNISNSSTFTKSLSRYESMLRTASSPDSLRSRTPMITPDLESGTKLWHLVKNHDHLDQREGDRGSKMVSEIYLTRLLATKGTLQKFVDDLFETIFSTAHRGSALPLAIKYMFDFLDEQADKHQIHDADVRHTWKSNCLPLRFWVNVIKNPQFVFDIHKNSITDACLSVVAQTFMDSCSTSEHKLGKDSPSNKLLYAKDIPNYKSWVERYYADIAKMPAISDQDMSAYLAEQSRLHLSQFNSMSALHEIYSYITKYKDEILAALEKDEQARRQRLRSKLEQVVDTMALSS

SEQ ID NO: 1201 - protein, 211 aa, Homo sapiens [sequence omitted]

SEQ ID NO: 1202 - protein, 879 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGSQPQEPENKKCSCVMCFPKGVPRSQEARTESSQASDMMDTMDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMENKFLPEPPSTRKKRILESHNNTLVDPCEEHKKKNPDASVKFSEFLKKCSETWKTIFAKEKGKFEDMAKADKAHYEREMKTYIPPKGEKKKKFKDPNAPKRPPLAFFLFCSEYRPKIKGEHPGLSIDDVVKKLAGMWNNTAAADKQFYEKKAAKLKEKYKKDIAAYRAKGKPNSAKKRVVKAEKSKKKKEEEEDEEDEQEEENEEDDDK

SEQ ID NO: 1203 - protein, 772 aa, Homo sapiens
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQVPSGEDQTALSLEECLRLLEATCPFGENAEFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 1204 - protein, 943 aa, Homo sapiens
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQVSAPPSSSCPPGLEHSLCPSSPSPPLPPATQEPTCLQPCSPACPPATGRPQHLPSTVRRDESPTAGPRLLPEVHEDGSPNLAPIPVTVKREPEELDQLYLDDVNEIIRNDLSSTSTHS

SEQ ID NO: 1205 - protein, 1464 aa, Homo sapiens
MSGMGENTSDPSRAETRKRKECPDQLGPSPKRNTEKRNREQENKYIEELAELIFANFNDIDNFNFKPDKCAILKETVKQIRQIKEQEKAAAANIDEVQKSDVSSTGQGVIDKDALGPMMLEALDGFFFVVNLEGNVVFVSENVTQYLRYNQEELMNKSVYSILHVGDHTEFVKNLLPKSIVNGGSWSGEPPRRNSHTFNCRMLVKPLPDSEEEGHDNQEAHQKYETMQCFAVSQPKSIKEEGEDLQSCLICVARRVPMKERPVLPSSESFTTRQDLQGKITSLDTSTMRAAMKPGWEDLVRRCIQKFHAQHEGESVSYAKRHHHEVLRQGLAFSQIYRFSLSDGTLVAAQTKSKLIRSQTTNEPQLVISLHMLHREQNVCVMNPDLTGQTMGKPLNPISSNSPAHQALCSGNPGQDMTLSSNINFPINGPKEQMGMPMGRFGGSGGMNHVSGMQATTPQGSNYALKMNSPSQSSPGMNPGQPTSMLSPRHRMSPGVAGSPRIPPSQFSPAGSLHSPVGVCSSTGNSHSYTNSSLNALQALSEGHGVSLGSSLASPDLKMGNLQNSPVNMNPPPLSKMGSLDSKDCFGLYGEPSEGTTGQAESSCHPGEQKETNDPNLPPAVSSERADGQSRLHDSKGQTKLLQLLTTKSDQMEPSPLASSLSDTNKDSTGSLPGSGSTHGTSLKEKHKILHRLLQDSSSPVDLAKLTAEATGKDLSQESSSTAPGSEVTIKQEPVSPKKKENALLRYLLDKDDTKDIGLPEITPKLERLDSKTDPASNTKLIAMKTEKEEMSFEPGDQPGSELDNLEEILDDLQNSQLPQLFPDTRPGAPAGSVDKQAIINDLMQLTAENSPVTPVGAQKTALRISQSTFNNPRPGQLGRLLPNQNLPLDITLQSPTGAGPFPPIRNSSPYSVIPQPGMMGNQGMIGNQGNLGNSSTGMIGNSASRPTMPSGEWAPQSSAVRVTCAATTSAMNRPVQGGMIRNPAASIPMRPSSQPGQRQTLQSQVMNIGPSELEMNMGGPQYSQQQAPPNQTAPWPESILPIDQASFASQNRQPFGSSPDDLLCPHPAAESPSDEGALLDQLYLALRNFDGLEEIDRALGIPELVSQSQAVDPEQFSSQDSNIMLEQKAPVFPQQYASQAQMAQGSYSPMQDPNFHTMGQRPSYATLRMQPRPGLRPTGLVQNQPNQLRLQLQHRLQAQQNRQPLMNQISNVSNVNLTLRPGVPTQAPINAQMLAQRQREILNQHLRQRQMHQQQQVQQRTLMMRGQGLNMTPSMVAPSGMPATMSNPRIPQANAQQFPFPPNYGISQQPDPGFTGATTPQSPLMSPRMAHTQSPMMQQSQANPAYQAPSDINGWAQGNMGGNSMFSQQSPPHFGQQANTSMYSNNMNINVSMATNTGGMSSMNQMTGQISMTSVTSVPTSGLSSMGPEQVNDPALRGGNLFPNQLPGMDMIKQEGDTTRKYC

SEQ ID NO: 1206 - protein, 793 aa, Homo sapiens
MWIQVRTMDGRQTHTVDSLSRLTKVEELRRKIQELFHVEPGLQRLFYRGKQMEDGHTLFDYEVRLNDTIQLLVRQSLVLPHSTKERDSELSDTDSGCCLGQSESDKSSTHGEAAAETDSRPADEDMWDETELGLYKVNEYVDARDTNMGAWFEAQVVRVTRKAPSRDEPCSSTSRPALEEDVIYHVKYDDYPENGVVQMNSRDVRARARTIIKWQDLEVGQVVMLNYNPDNPKERGFWYDAEISRKRETRTARELYANVVLGDDSLNDCRIIFVDEVFKIERPGEGSPMVDNPMRRKSGPSCKHCKDDVNRLCRVCACHLCGGRQDPDKQLMCDECDMAFHIYCLDPPLSSVPSEDEWYCPECRNDASEVVLAGERLRESKKKAKMASATSSSQRDWGKGMACVGRTKECTIVPSNHYGPIPGIPVGTMWRFRVQVSESGVHRPHVAGIHGRSNDGAYSLVLAGGYEDDVDHGNFFTYTGSGGRDLSGNKRTAEQSCDQKLTNTNRALALNCFAPINDQEGAEAKDWRSGKPVRVVRNVKGGKNSKYAPAEGNRYDGIYKVVKYWPEKGKSGFLVWRYLLRRDDDEPGPWTKEGKDRIKKLGLTMQYPEGYLEALANREREKENSKREEEEQQEGGFASPRTGKGKWKRKSAGGGPSRAGSPRRTSKKTKVEPYSLTAQQSSLIREDKSNAKLWNEVLASLKDRPASGSPFQLFLSKVEETFQCICCQELVFRPITTVCQHNVCKDCLDRSFRAQVFSCPACRYDLGRSYAMQVNQPLQTVLNQLFPGYGNGR

SEQ ID NO: 1207 - protein, 1369 aa, Homo sapiens
MGGKNKKHKAPAAAVVRAAVSASRAKSAEAGIAGEAQSKKPVSRPATAAAAAAGSREPRVKQGPKIYSFNSTNDSSGPANLDKSILKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQIQATISPPLQPKTKTYEEDPKSKPKKEEKNMEVNMKEWILRYAEQQNEEEKNENSKSLEEEEKFDPNERYLHLAAKLLDAKEQAATFKLEKNKQGQKEAQEKIRKFQREMETLEDHPVFNPAMKISHQQNERKKPPVATEGESALNFNLFEKSAAATEEEKGKKKEPHDVRNFDYTARSWTGKSPKQFLIDWVRKNLPKSPNPSFEKVPVGRYWKCRVRVIKSEDDVLVVCPTILTEDGMQAQHLGATLALYRLVKGQSVHQLLPPTYRDVWLEWSDAEKKREELNKMETNKPRDLFIAKLLNKLKQQQQQQQQHSENKRENSEDPEESWENLVSDEDFSALSLESANVEDLEPVRNLFRKLQSTPKYQKLLKERQQLPVFKHRDSIVETLKRHRVVVVAGETGSGKSTQVPHFLLEDLLLNEWEASKCNIVCTQPRRISAVSLANRVCDELGCENGPGGRNSLCGYQIRMESRACESTRLLYCTTGVLLRKLQEDGLLSNVSHVIVDEVHERSVQSDFLLIILKEILQKRSDLHLILMSATVDSEKFSTYFTHCPILRISGRSYPVEVFHLEDIIEETGFVLEKDSEYCQKFLEEEEEVTINVTSKAGGIKKYQEYIPVQTGAHADLNPFYQKYSSRTQHAILYMNPHKINLDLILELLAYLDKSPQFRNIEGAVLIFLPGLAHIQQLYDLLSNDRRFYSERYKVIALHSILSTQDQAAAFTLPPPGVRKIVLATNIAETGITIPDVVFVIDTGRTKENKYHESSQMSSLVETFVSKASALQRQGRAGRVRDGFCFRMYTRERFEGFMDYSVPEILRVPLEELCLHIMKCNLGSPEDFLSKALDPPQLQVISNAMNLLRKIGACELNEPKLTPLGQHLAALPVNVKIGKMLIFGAIFGCLDPVATLAAVMTEKSPFTTPIGRKDEADLAKSALAMADSDHLTIYNAYLGWKKARQEGGYRSEITYCRRNFLNRTSLLTLEDVKQELIKLVKAAGFSSSTTSTSWEGNRASQTLSFQEIALLKAVLVAGLYDNVGKIIYTKSVDVTEKLACIVETAQGKAQVHPSSVNRDLQTHGWLLYQEKIRYARVYLRETTLITPFPVLLFGGDIEVQHRERLLSIDGWIYFQAPVKIAVIFKQLRVLIDSVLRKKLENPKMSLENDKILQIITELIKTENN

SEQ ID NO: 1208 - protein, 522 aa, Homo sapiens
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQGTAPTGFVFGPSTTSVAPATTSGGFSFTGGSTAQPSGFNIGSAGNSAQPTAPATLPFTPATPAATTAGATQPAAPTPTATITSTGPSLFASIATAPTSSATTGLSLCTPVTTAGAPTAGTQGFSLKAPGAASGTSTTTSTAATATATTTSSSSTTGFALNLKPLAPAGIPSNTAAAVTAPPGPGAAAGAAASSAMTYAQLESLINKWSLELEDQERHFLQQATQVNAWDRTLIENGEKITSLHREVEKVKLDQKRLDQELDFILSQQKELEDLLSPLEELVKEQSGTIYLQHADEEREKTYKLAENIDAQLKRMAQDLKDIIEHLNTSGAPADTSDPLQQICKILNAHMDSLQWIDQNSALLQRKVEEVTKVCEGRRKEQERSFRITFD

SEQ ID NO: 1209 - protein, 1729 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGNKPTLTLGTNTNTSNFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEGVLQASYAGQLESEGLWEWAIFVLLHIDNSGIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQVEHFNDSNIVQVMTWSSYTSK

SEQ ID NO: 1210 - protein, 2349 aa, Homo sapiens
MAAVLQQVLERTELNKLPKSVQNKLEKFLADQQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTEDVKRLNEKLKESNTTKGELQLKLDELQASDVSVKYREKRLEQEKELLHSQNTWLNTELKTKTDELLALGREKGNEILELKCNLENKKEEVSRLEEQMNGLKTSNEHLQKHVEDLLTKLKEAKEQQASMEEKFHNELNAHIKLSNLYKSAADDSEAKSNELTRAVEELHKLLKEAGEANKAIQDHLLEVEQSKDQMEKEMLEKIGRLEKELENANDLLSATKRKGAILSEEELAAMSPTAAAVAKIVKPGMKLTELYNAYVETQDQLLLEKLENKRINKYLDEIVKEVEAKAPILKRQREEYERAQKAVASLSVKLEQAMKEIQRLQEDTDKANKQSSVLERDNRRMEIQVKDLSQQIRVLLMELEEARGNHVIRDEEVSSADISSSSEVISQHLVSYRNIEELQQQNQRLLVALRELGETREREEQETTSSKITELQLKLESALTELEQLRKSRQHQMQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGILERSETETKQRLSSQIEKLEHEISHLKKKLENEVEQRHTLTRNLDVQLLDTKRQLDTETNLHLNTKELLKNAQKEIATLKQHLSNMEVQVASQSSQRTGKGQPSNKEDVDDLVSQLRQTEEQVNDLKERLKTSTSNVEQYQAMVTSLEESLNKEKQVTEEVRKNIEVRLKESAEFQTQLEKKLMEVEKEKQELQDDKRRAIESMEQQLSELKKTLSSVQNEVQEALQRASTALSNEQQARRDCQEQAKIAVEAQNKYERELMLHAADVEALQAAKEQVSKMASVRQHLEETTQKAESQLLECKASWEERERMLKDEVSKCVCRCEDLEKQNRLLHDQIEKLSDKVVASVKEGVQGPLNVSLSEEGKSQEQILEILRFIRREKEIAETRFEVAQVESLRYRQRVELLERELQELEDSLNAEREKVQVTAKTMAQHEELMKKTETMNVVMETNKMLREEKERLEQDLQQMQAKVRKLELDILPLQEANAELSEKSGMLQAEKKLLEEDVKRWKARNQHLVSQQKDPDTEEYRKLLSEKEVHTKRIQQLTEEIGRLKAEIARSNASLTNNQNLIQSLKEDLNKVRTEKETIQKDLDAKIIDIQEKVKTITQVKKIGRRYKTQYEELKAQQDKVMETSAQSSGDHQEQHVSVQEMQELKETLNQAETKSKSLESQVENLQKTLSEKETEARNLQEQTVQLQSELSRLRQDLQDRTTQEEQLRQQITEKEEKTRKAIVAAKSKIAHLAGVKDQLTKENEELKQRNGALDQQKDELDVRITALKSQYEGRISRLERELREHQERHLEQRDEPQEPSNKVPEQQRQITLKTTPASGERGIASTSDPPTANIKPTPVVSTPSKVTAAAMAGNKSTPRASIRPMVTPATVTNPTTTPTATVMPTTQVESQEAMQSEGPVEHVPVFGSTSGSVRSTSPNVQPSISQPILTVQQQTQATAFVQPTQQSHPQIEPANQELSSNIVEVVQSSPVERPSTSTAVFGTVSATPSSSLPKRTREEEEDSTIEASDQVSDDTVEMPLPKKLKSVTPVGTEEEVMAEESTDGEVETQVYNQDSQDSIGEGVTQGDYTPMEDSEETSQSLQIDLGPLQSDQQTTTSSQDGQGKGDDVIVIDSDDEEEDEEDDDDDEDDTGMGDEGEDSNEGTGSADGNDGYEADDAEGGDGTDPGTETEESMGGGEGNHRAADSQNSGEGNTGAAESSFSQEVSREQQPSSASERQAPRAPQSPRRPPHPLPPRLTIHAPPQELGPPVQRIQMTRRQSVGRGLQLTPGIGGMQQHFFDDEDRTVPSTPTLVVPHRTDGFAEAIHSPQVAGVPRFRFGPPEDMPQTSSSHSDLGQLASQGGLGMYETPLFLAHEEESGGRSVPTTPLQVAAPVTVFTESTTSDASEHASQSVPMVTTSTGTLSTTNETATGDDGDEVFVEAESEGISSEAGLEIDSQQEEEPVQASDESDLPSTSQDPPSSSSVDTSSSQPKPFRRVRLQTTLRQGVRGRQFNRQRGVSHAMGGRGGINRGNIN

SEQ ID NO: 1211 - protein, 925 aa, Homo sapiens
MDRSGFGEISSPVIREAEVTRTARKQSAQKRVLLQASQDENFGNTTPRNQVIPRTPSSFRQPFTPTSRSLLRQPDISCILGTGGKSPRLTQSSGFFGNLSMVTNLDDSNWAAAFSSQRSGLFTNTEPHSITEDVTISAVMLREDDPGEAASMSMFSDFLQSFLKHSSSTVFDLVEEYENICGSQVNILSKIVSRATPGLQKFSKTASMLWLLQQEMVTWRLLASLYRDRIQSALEEESVFAVTAVNASEKTVVEALFQRDSLVRQSQLVVDWLESIAKDEIGEFSDNIEFYAKSVYWENTLHTLKQRQLTSYVGSVRPLVTELDPDAPIRQKMPLDDLDREDEVRLLKYLFTLIRAGMTEEAQRLCKRCGQAWRAATLEGWKLYHDPNVNGGTELEPVEGNPYRRIWKISCWRMAEDELFNRYERAIYAALSGNLKQLLPVCDTWEDTVWAYFRVMVDSLVEQEIQTSVATLDETEELPREYLGANWTLEKVFEELQATDKKRVLEENQEHYHIVQKFLILGDIDGLMDEFSKWLSKSRNNLPGHLLRFMTHLILFFRTLGLQTKEEVSIEVLKTYIQLLIREKHTNLIAFYTCHLPQDLAVAQYALFLESVTEFEQRHHCLELAKEADLDVATITKTVVENIRKKDNGEFSHHDLAPALDTGTTEEDRLKIDVIDWLVFDPAQRAEALKQGNAIMRKFLASKKHEAAKEVFVKIPQDSIAEIYNQCEEQGMESPLPAEDDNAIREHLCIRAYLEAHETFNEWFKHMNSVPQKPALIPQPTFTEKVAHEHKEKKYEMDFGIWKGHLDALTADVKEKMYNVLLFVDGGWMVDVREDAKEDHERTHQMVLLRKLCLPMLCFLLHTILHSTGQYQECLQLADMVSSERHKLYLVFSKEELRKLLQKLRESSLMLLDQGLDPLGYEIQL

SEQ ID NO: 1212 - protein, 2012 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKQTSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLLRISRN

SEQ ID NO: 1213 - protein, 174 aa, Homo sapiens
QKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 1214 - protein, 420 aa, Homo sapiens
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLAVLPAGAFARRPPLAELAALNLSGSRLDEVRAGAFEHLPSLRQLDLSHNPLADLSPFAFSGSNASVSAPSPLVELILNHIVPPEDERQNRSFEGMVVAALLAGRALQGLRRLELASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTSYVFLGIVLALIGAIFLLVLYLNRKGIKKWMHNIRDACRDHMEGYHYRYEINADPRLTNLSSNSDV

SEQ ID NO: 1215 - protein, 960 aa, Homo sapiens
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPNSEDLVKLAPDFDKIVESLSLLKDFFTSGSPEETAFRATDRGSESDKHFRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 1216 - protein, 444 aa, Homo sapiens
MSGTKLEDSPPCRNWSSASELNETQEPFLNPTDYDDEEFLRYLWREYLHPKEYEWVLIAGYIIVFVVALIGNVLVCVAVWKNHHMRTVTNYFIVNLSLADVLVTITCLPATLVVDITETWFFGQSLCKVIPYLQTVSVSVSVLTLSCIALDRWYAICHPLMFKSTAKRARNSIVIIWIVSCIIMIPQAIVMECSTVFPGLANKTTLFTVCDERWGGEIYPKMYHICFFLVTYMAPLCLMVLAYLQIFRKLWCRQIPGTSSVVQRKWKPLQPVSQPRGPGQPTKSRMSAVAAEIKQIRARRKTARMLMVVLLVFAICYLPISILNVLKRVFGMFAHTEDRETVYAWFTFSHWLVYANSAANPIIYNFLSGKFREEFKAAFSCCCLGVHHRQEDRLTRGRTSTESRKSLTTQISNFDNISKLSEQVVLTSISTLPAANGAGPLQNW

SEQ ID NO: 1217 - protein, 219 aa, Homo sapiens
MSGLSGPPARRGPFPLALLLLFLLGPRLVLAISFHLPINSRKCLREEIHKDLLVTGAYEISDQSGGAGGLRSHLKITDSAGHILYSKEDATKGKFAFTTEDYDMFEVCFESKGTGRIPDQLVILDMKHGVEAKNYEEIAKVEKLKPLEVELRRLEDLSESIVNDFAYMKKREEEMRDTNESTNTRVLYFSIFSMFCLIGLATWQVFYLRRFFKAKKLIE

SEQ ID NO: 1218 - protein, 483 aa, Homo sapiens
MATIEEIAHQIIEQQMGEIVTEQQTGQKIQIVTALDHNTQGKQFILTNHDGSTPSKVILARQDSTPGKVFLTTPDAAGVNQLFFTTPDLSAQHLQLLTDNSPDQGPNKVFDLCVVCGDKASGRHYGAVTCEGCKGFFKRSIRKNLVYSCRGSKDCIINKHHRNRCQYCRLQRCIAFGMKQDSVQCERKPIEVSREKSSNCAASTEKIYIRKDLRSPLTATPTFVTDSESTRSTGLLDSGMFMNIHPSGVKTESAVLMTSDKAESCQGDLSTLANVVTSLANLGKTKDLSQNSNEMSMIESLSNDDTSLCEFQEMQTNGDVSRAFDTLAKALNPGESTACQSSVAGMEGSVHLITGDSSINYTEKEGPLLSDSHVAFRLTMPSPMPEYLNVHYIGESASRLLFLSMHWALSIPSFQALGQENSISLVKAYWNELFTLGLAQCWQVMNVATILATFVNCLHNSLQQDAKVIAALIHFTRRAITDL

SEQ ID NO: 1219 - protein, 931 aa, Homo sapiens
MPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 1220 - protein, 22152 aa, Homo sapiens
  misc_feature (13877)..(13878): Xaa can be any naturally occurring amino acid
  misc_feature (13880)..(13880): Xaa can be any naturally occurring amino acid
  misc_feature (13887)..(13887): Xaa can be any naturally occurring amino acid
  misc_feature (13890)..(13891): Xaa can be any naturally occurring amino acid
  misc_feature (13893)..(13893): Xaa can be any naturally occurring amino acid
  misc_feature (13903)..(13903): Xaa can be any naturally occurring amino acid
  misc_feature (13913)..(13914): Xaa can be any naturally occurring amino acid
  misc_feature (13916)..(13916): Xaa can be any naturally occurring amino acid
  misc_feature (13928)..(13929): Xaa can be any naturally occurring amino acid
  misc_feature (13938)..(13938): Xaa can be any naturally occurring amino acid
  misc_feature (13940)..(13941): Xaa can be any naturally occurring amino acid
  misc_feature (14569)..(14571): Xaa can be any naturally occurring amino acid
  misc_feature (14575)..(14575): Xaa can be any naturally occurring amino acid
  misc_feature (14579)..(14579): Xaa can be any naturally occurring amino acid
  misc_feature (14581)..(14581): Xaa can be any naturally occurring amino acid
  misc_feature (14587)..(14591): Xaa can be any naturally occurring amino acid
  misc_feature (14593)..(14594): Xaa can be any naturally occurring amino acid
  misc_feature (14725)..(14727): Xaa can be any naturally occurring amino acid
  misc_feature (14731)..(14731): Xaa can be any naturally occurring amino acid
  misc_feature (14735)..(14735): Xaa can be any naturally occurring amino acid
  misc_feature (14737)..(14737): Xaa can be any naturally occurring amino acid
  misc_feature (14743)..(14747): Xaa can be any naturally occurring amino acid
  misc_feature (14749)..(14750): Xaa can be any naturally occurring amino acid
  misc_feature (15661)..(15663): Xaa can be any naturally occurring amino acid
  misc_feature (15667)..(15667): Xaa can be any naturally occurring amino acid
  misc_feature (15671)..(15671): Xaa can be any naturally occurring amino acid
  misc_feature (15673)..(15673): Xaa can be any naturally occurring amino acid
  misc_feature (15679)..(15683): Xaa can be any naturally occurring amino acid
  misc_feature (15685)..(15686): Xaa can be any naturally occurring amino acid
  misc_feature (15972)..(15974): Xaa can be any naturally occurring amino acid
  misc_feature (15978)..(15978): Xaa can be any naturally occurring amino acid
  misc_feature (15982)..(15982): Xaa can be any naturally occurring amino acid
  misc_feature (15984)..(15984): Xaa can be any naturally occurring amino acid
  misc_feature (15990)..(15994): Xaa can be any naturally occurring amino acid
  misc_feature (15996)..(15997): Xaa can be any naturally occurring amino acid
  misc_feature (16008)..(16008): Xaa can be any naturally occurring amino acid
  misc_feature (16015)..(16015): Xaa can be any naturally occurring amino acid
  misc_feature (16017)..(16017): Xaa can be any naturally occurring amino acid
  misc_feature (16021)..(16021): Xaa can be any naturally occurring amino acid
  misc_feature (16025)..(16025): Xaa can be any naturally occurring amino acid
  misc_feature (16034)..(16034): Xaa can be any naturally occurring amino acid
  misc_feature (16037)..(16037): Xaa can be any naturally occurring amino acid
  misc_feature (16040)..(16040): Xaa can be any naturally occurring amino acid
  misc_feature (16046)..(16046): Xaa can be any naturally occurring amino acid
  misc_feature (16051)..(16051): Xaa can be any naturally occurring amino acid
  misc_feature (16053)..(16055): Xaa can be any naturally occurring amino acid
  misc_feature (16058)..(16058): Xaa can be any naturally occurring amino acid
  misc_feature (16062)..(16063): Xaa can be any naturally occurring amino acid
  misc_feature (16065)..(16065): Xaa can be any naturally occurring amino acid
  misc_feature (16072)..(16072): Xaa can be any naturally occurring amino acid
  misc_feature (16075)..(16076): Xaa can be any naturally occurring amino acid
  misc_feature (16078)..(16078): Xaa can be any naturally occurring amino acid
  misc_feature (16088)..(16088): Xaa can be any naturally occurring amino acid
  misc_feature (16268)..(16269): Xaa can be any naturally occurring amino acid
  misc_feature (16278)..(16278): Xaa can be any naturally occurring amino acid
  misc_feature (16280)..(16281): Xaa can be any naturally occurring amino acid
  misc_feature (16373)..(16374): Xaa can be any naturally occurring amino acid
  misc_feature (16376)..(16376): Xaa can be any naturally occurring amino acid
  misc_feature (16383)..(16383): Xaa can be any naturally occurring amino acid
  misc_feature (16386)..(16387): Xaa can be any naturally occurring amino acid
  misc_feature (16389)..(16389): Xaa can be any naturally occurring amino acid
  misc_feature (16399)..(16399): Xaa can be any naturally occurring amino acid
  misc_feature (16409)..(16410): Xaa can be any naturally occurring amino acid
  misc_feature (16412)..(16412): Xaa can be any naturally occurring amino acid
  misc_feature (16424)..(16425): Xaa can be any naturally occurring amino acid
  misc_feature (16434)..(16434): Xaa can be any naturally occurring amino acid
  misc_feature (16436)..(16437): Xaa can be any naturally occurring amino acid
  misc_feature (16439)..(16441): Xaa can be any naturally occurring amino acid
  misc_feature (16445)..(16445): Xaa can be any naturally occurring amino acid
  misc_feature (16449)..(16449): Xaa can be any naturally occurring amino acid
  misc_feature (16451)..(16451): Xaa can be any naturally occurring amino acid
  misc_feature (16457)..(16461): Xaa can be any naturally occurring amino acid
  misc_feature (16463)..(16464): Xaa can be any naturally occurring amino acid
  misc_feature (16841)..(16842): Xaa can be any naturally occurring amino acid
  misc_feature (16844)..(16844): Xaa can be any naturally occurring amino acid
  misc_feature (16851)..(16851): Xaa can be any naturally occurring amino acid
  misc_feature (16854)..(16855): Xaa can be any naturally occurring amino acid
  misc_feature (16857)..(16857): Xaa can be any naturally occurring amino acid
  misc_feature (16867)..(16867): Xaa can be any naturally occurring amino acid
  misc_feature (16877)..(16878): Xaa can be any naturally occurring amino acid
  misc_feature (16880)..(16880): Xaa can be any naturally occurring amino acid
  misc_feature (16892)..(16893): Xaa can be any naturally occurring amino acid
  misc_feature (16902)..(16902): Xaa can be any naturally occurring amino acid
  misc_feature (16904)..(16905): Xaa can be any naturally occurring amino acid
  misc_feature (16907)..(16909): Xaa can be any naturally occurring amino acid
  misc_feature (16913)..(16913): Xaa can be any naturally occurring amino acid
  misc_feature (16917)..(16917): Xaa can be any naturally occurring amino acid
  misc_feature (16919)..(16919): Xaa can be any naturally occurring amino acid
  misc_feature (16925)..(16929): Xaa can be any naturally occurring amino acid
  misc_feature (16931)..(16932): Xaa can be any naturally occurring amino acid
  misc_feature (17465)..(17466): Xaa can be any naturally occurring amino acid
  misc_feature (17468)..(17468): Xaa can be any naturally occurring amino acid
  misc_feature (17475)..(17475): Xaa can be any naturally occurring amino acid
  misc_feature (17478)..(17479): Xaa can be any naturally occurring amino acid
  misc_feature (17481)..(17481): Xaa can be any naturally occurring amino acid
  misc_feature (17491)..(17491): Xaa can be any naturally occurring amino acid
  misc_feature (17501)..(17502): Xaa can be any naturally occurring amino acid
  misc_feature (17504)..(17504): Xaa can be any naturally occurring amino acid
  misc_feature (17516)..(17517): Xaa can be any naturally occurring amino acid
  misc_feature (17526)..(17526): Xaa can be any naturally occurring amino acid
  misc_feature (17528)..(17529): Xaa can be any naturally occurring amino acid
  misc_feature (17531)..(17533): Xaa can be any naturally occurring amino acid
  misc_feature (17537)..(17537): Xaa can be any naturally occurring amino acid
  misc_feature (17541)..(17541): Xaa can be any naturally occurring amino acid
  misc_feature (17543)..(17543): Xaa can be any naturally occurring amino acid
  misc_feature (17549)..(17553): Xaa can be any naturally occurring amino acid
  misc_feature (17555)..(17556): Xaa can be any naturally occurring amino acid
  misc_feature (17567)..(17567): Xaa can be any naturally occurring amino acid
  misc_feature (17574)..(17574): Xaa can be any naturally occurring amino acid
  misc_feature (17576)..(17576): Xaa can be any naturally occurring amino acid
  misc_feature (17580)..(17580): Xaa can be any naturally occurring amino acid
  misc_feature (17584)..(17584): Xaa can be any naturally occurring amino acid
  misc_feature (17593)..(17593): Xaa can be any naturally occurring amino acid
  misc_feature (17596)..(17596): Xaa can be any naturally occurring amino acid
  misc_feature (17599)..(17599): Xaa can be any naturally occurring amino acid
  misc_feature (17605)..(17605): Xaa can be any naturally occurring amino acid
  misc_feature (17610)..(17610): Xaa can be any naturally occurring amino acid
  misc_feature (17612)..(17614): Xaa can be any naturally occurring amino acid
  misc_feature (17617)..(17617): Xaa can be any naturally occurring amino acid
  misc_feature (17621)..(17622): Xaa can be any naturally occurring amino acid
  misc_feature (17624)..(17624): Xaa can be any naturally occurring amino acid
  misc_feature (17631)..(17631): Xaa can be any naturally occurring amino acid
  misc_feature (17777)..(17778): Xaa can be any naturally occurring amino acid
  misc_feature (17780)..(17780): Xaa can be any naturally occurring amino acid
  misc_feature (17787)..(17787): Xaa can be any naturally occurring amino acid
  misc_feature (17790)..(17791): Xaa can be any naturally occurring amino acid
  misc_feature (17793)..(17793): Xaa can be any naturally occurring amino acid
  misc_feature (17803)..(17803): Xaa can be any naturally occurring amino acid
  misc_feature (17813)..(17814): Xaa can be any naturally occurring amino acid
  misc_feature (17816)..(17816): Xaa can be any naturally occurring amino acid
  misc_feature (17828)..(17829): Xaa can be any naturally occurring amino acid
  misc_feature (17838)..(17838): Xaa can be any naturally occurring amino acid
  misc_feature (17840)..(17841): Xaa can be any naturally occurring amino acid
  misc_feature (17843)..(17845): Xaa can be any naturally occurring amino acid
  misc_feature (17849)..(17849): Xaa can be any naturally occurring amino acid
  misc_feature (17853)..(17853): Xaa can be any naturally occurring amino acid
  misc_feature (17855)..(17855): Xaa can be any naturally occurring amino acid
  misc_feature (17861)..(17865): Xaa can be any naturally occurring amino acid
  misc_feature (17867)..(17868): Xaa can be any naturally occurring amino acid
  misc_feature (17879)..(17879): Xaa can be any naturally occurring amino acid
  misc_feature (17886)..(17886): Xaa can be any naturally occurring amino acid
  misc_feature (17888)..(17888): Xaa can be any naturally occurring amino acid
  misc_feature (17892)..(17892): Xaa can be any naturally occurring amino acid
  misc_feature (17896)..(17896): Xaa can be any naturally occurring amino acid
  misc_feature (17905)..(17905): Xaa can be any naturally occurring amino acid
  misc_feature (17908)..(17908): Xaa can be any naturally occurring amino acid
  misc_feature (17911)..(17911): Xaa can be any naturally occurring amino acid
  misc_feature (17917)..(17917): Xaa can be any naturally occurring amino acid
  misc_feature (17922)..(17922): Xaa can be any naturally occurring amino acid
  misc_feature (17924)..(17926): Xaa can be any naturally occurring amino acid
  misc_feature (17929)..(17929): Xaa can be any naturally occurring amino acid
  misc_feature (17933)..(17934): Xaa can be any naturally occurring amino acid
  misc_feature (17936)..(17936): Xaa can be any naturally occurring amino acid
  misc_feature (17943)..(17943): Xaa can be any naturally occurring amino acid
  misc_feature (17946)..(17947): Xaa can be any naturally occurring amino acid
  misc_feature (17949)..(17949): Xaa can be any naturally occurring amino acid
  misc_feature (17959)..(17959): Xaa can be any naturally occurring amino acid
  misc_feature (18089)..(18090): Xaa can be any naturally occurring amino acid
  misc_feature (18092)..(18092): Xaa can be any naturally occurring amino acid
  misc_feature (18099)..(18099): Xaa can be any naturally occurring amino acid
  misc_feature (18102)..(18103): Xaa can be any naturally occurring amino acid
  misc_feature (18105)..(18105): Xaa can be any naturally occurring amino acid
  misc_feature (18115)..(18115): Xaa can be any naturally occurring amino acid
  misc_feature (18125)..(18126): Xaa can be any naturally occurring amino acid
  misc_feature (18128)..(18128): Xaa can be any naturally occurring amino acid
  misc_feature (18140)..(18141): Xaa can be any naturally occurring amino acid
  misc_feature (18150)..(18150): Xaa can be any naturally occurring amino acid
  misc_feature (18152)..(18153): Xaa can be any naturally occurring amino acid
  misc_feature (18155)..(18157): Xaa can be any naturally occurring amino acid
  misc_feature (18161)..(18161): Xaa can be any naturally occurring amino acid
  misc_feature (18165)..(18165): Xaa can be any naturally occurring amino acid
  misc_feature (18167)..(18167): Xaa can be any naturally occurring amino acid
  misc_feature (18173)..(18177): Xaa can be any naturally occurring amino acid
  misc_feature (18179)..(18180): Xaa can be any naturally occurring amino acid
  misc_feature (18191)..(18191): Xaa can be any naturally occurring amino acid
  misc_feature (18198)..(18198): Xaa can be any naturally occurring amino acid
  misc_feature (18200)..(18200): Xaa can be any naturally occurring amino acid
  misc_feature (18204)..(18204): Xaa can be any naturally occurring amino acid
  misc_feature (18208)..(18208): Xaa can be any naturally occurring amino acid
  misc_feature (18217)..(18217): Xaa can be any naturally occurring amino acid
  misc_feature (18220)..(18220): Xaa can be any naturally occurring amino acid
  misc_feature (18223)..(18223): Xaa can be any naturally occurring amino acid
  misc_feature (18229)..(18229): Xaa can be any naturally occurring amino acid
  misc_feature (18234)..(18234): Xaa can be any naturally occurring amino acid
  misc_feature (18236)..(18238): Xaa can be any naturally occurring amino acid
  misc_feature (18241)..(18241): Xaa can be any naturally occurring amino acid
  misc_feature (18245)..(18246): Xaa can be any naturally occurring amino acid
  misc_feature (18248)..(18248): Xaa can be any naturally occurring amino acid
  misc_feature (18255)..(18255): Xaa can be any naturally occurring amino acid
  misc_feature (18258)..(18259): Xaa can be any naturally occurring amino acid
  misc_feature (18261)..(18261): Xaa can be any naturally occurring amino acid
  misc_feature (18271)..(18271): Xaa can be any naturally occurring amino acid
  misc_feature (18401)..(18402): Xaa can be any naturally occurring amino acid
  misc_feature (18404)..(18404): Xaa can be any naturally occurring amino acid
  misc_feature (18411)..(18411): Xaa can be any naturally occurring amino acid
  misc_feature (18414)..(18415): Xaa can be any naturally occurring amino acid
  misc_feature (18417)..(18417): Xaa can be any naturally occurring amino acid
  misc_feature (18427)..(18427): Xaa can be any naturally occurring amino acid
  misc_feature (18437)..(18438): Xaa can be any naturally occurring amino acid
  misc_feature (18440)..(18440): Xaa can be any naturally occurring amino acid
  misc_feature (18452)..(18453): Xaa can be any naturally occurring amino acid
  misc_feature (18462)..(18462): Xaa can be any naturally occurring amino acid
  misc_feature (18464)..(18465): Xaa can be any naturally occurring amino acid
  misc_feature (18467)..(18469): Xaa can be any naturally occurring amino acid
  misc_feature (18473)..(18473): Xaa can be any naturally occurring amino acid
  misc_feature (18477)..(18477): Xaa can be any naturally occurring amino acid
  misc_feature (18479)..(18479): Xaa can be any naturally occurring amino acid
  misc_feature (18485)..(18489): Xaa can be any naturally occurring amino acid
  misc_feature (18491)..(18492): Xaa can be any naturally occurring amino acid
  misc_feature (18503)..(18503): Xaa can be any naturally occurring amino acid
  misc_feature (18510)..(18510): Xaa can be any naturally occurring amino acid
  misc_feature (18512)..(18512): Xaa can be any naturally occurring amino acid
  misc_feature (18516)..(18516): Xaa can be any naturally occurring amino acid
  misc_feature (18520)..(18520): Xaa can be any naturally occurring amino acid
  misc_feature (18529)..(18529): Xaa can be any naturally occurring amino acid
  misc_feature (18532)..(18532): Xaa can be any naturally occurring amino acid
  misc_feature (18535)..(18535): Xaa can be any naturally occurring amino acid
  misc_feature (18541)..(18541): Xaa can be any naturally occurring amino acid
  misc_feature (18546)..(18546): Xaa can be any naturally occurring amino acid
  misc_feature (18548)..(18550): Xaa can be any naturally occurring amino acid
  misc_feature (18553)..(18553): Xaa can be any naturally occurring amino acid
  misc_feature (18557)..(18558): Xaa can be any naturally occurring amino acid
  misc_feature (18560)..(18560): Xaa can be any naturally occurring amino acid
  misc_feature (18567)..(18567): Xaa can be any naturally occurring amino acid
  misc_feature (18570)..(18571): Xaa can be any naturally occurring amino acid
  misc_feature (18573)..(18573): Xaa can be any naturally occurring amino acid
  misc_feature (18583)..(18583): Xaa can be any naturally occurring amino acid
  misc_feature (18713)..(18714): Xaa can be any naturally occurring amino acid
  misc_feature (18716)..(18716): Xaa can be any naturally occurring amino acid
  misc_feature (18723)..(18723): Xaa can be any naturally occurring amino acid
  misc_feature (18726)..(18727): Xaa can be any naturally occurring amino acid
  misc_feature (18729)..(18729): Xaa can be any naturally occurring amino acid
  misc_feature (18739)..(18739): Xaa can be any naturally occurring amino acid
  misc_feature (18749)..(18750): Xaa can be any naturally occurring amino acid
  misc_feature (18752)..(18752): Xaa can be any naturally occurring amino acid
  misc_feature (18764)..(18765): Xaa can be any naturally occurring amino acid
  misc_feature (18774)..(18774): Xaa can be any naturally occurring amino acid
  misc_feature (18776)..(18777): Xaa can be any naturally occurring amino acid
  misc_feature (18779)..(18781): Xaa can be any naturally occurring amino acid
  misc_feature (18785)..(18785): Xaa can be any naturally occurring amino acid
  misc_feature (18789)..(18789): Xaa can be any naturally occurring amino acid
  misc_feature (18791)..(18791): Xaa can be any naturally occurring amino acid
  misc_feature (18797)..(18801): Xaa can be any naturally occurring amino acid
  misc_feature (18803)..(18804): Xaa can be any naturally occurring amino acid
  misc_feature (18815)..(18815): Xaa can be any naturally occurring amino acid
  misc_feature (18822)..(18822): Xaa can be any naturally occurring amino acid
  misc_feature (18824)..(18824): Xaa can be any naturally occurring amino acid
  misc_feature (18828)..(18828): Xaa can be any naturally occurring amino acid
  misc_feature (18832)..(18832): Xaa can be any naturally occurring amino acid
  misc_feature (18841)..(18841): Xaa can be any naturally occurring amino acid
  misc_feature (18844)..(18844): Xaa can be any naturally occurring amino acid
  misc_feature (18847)..(18847): Xaa can be any naturally occurring amino acid
  misc_feature (18853)..(18853): Xaa can be any naturally occurring amino acid
  misc_feature (18858)..(18858): Xaa can be any naturally occurring amino acid
  misc_feature (18860)..(18862): Xaa can be any naturally occurring amino acid
  misc_feature (18865)..(18865): Xaa can be any naturally occurring amino acid
  misc_feature (18869)..(18870): Xaa can be any naturally occurring amino acid
  misc_feature (18872)..(18872): Xaa can be any naturally occurring amino acid
  misc_feature (18879)..(18879): Xaa can be any naturally occurring amino acid
  misc_feature (18882)..(18883): Xaa can be any naturally occurring amino acid
  misc_feature (18885)..(18885): Xaa can be any naturally occurring amino acid
  misc_feature (18895)..(18895): Xaa can be any naturally occurring amino acid
  misc_feature (19091)..(19093): Xaa can be any naturally occurring amino acid
  misc_feature (19097)..(19097): Xaa can be any naturally occurring amino acid
  misc_feature (19101)..(19101): Xaa can be any naturally occurring amino acid
  misc_feature (19103)..(19103): Xaa can be any naturally occurring amino acid
  misc_feature (19109)..(19113): Xaa can be any naturally occurring amino acid
  misc_feature (19115)..(19116): Xaa can be any naturally occurring amino acid
  misc_feature (19127)..(19127): Xaa can be any naturally occurring amino acid
  misc_feature (19134)..(19134): Xaa can be any naturally occurring amino acid
  misc_feature (19136)..(19136): Xaa can be any naturally occurring amino acid
  misc_feature (19140)..(19140): Xaa can be any naturally occurring amino acid
  misc_feature (19144)..(19144): Xaa can be any naturally occurring amino acid
  misc_feature (19153)..(19153): Xaa can be any naturally occurring amino acid
  misc_feature (19156)..(19156): Xaa can be any naturally occurring amino acid
  misc_feature (19159)..(19159): Xaa can be any naturally occurring amino acid
  misc_feature (19165)..(19165): Xaa can be any naturally occurring amino acid
  misc_feature (19170)..(19170): Xaa can be any naturally occurring amino acid
  misc_feature (19172)..(19174): Xaa can be any naturally occurring amino acid
  misc_feature (19177)..(19177): Xaa can be any naturally occurring amino acid
  misc_feature (19181)..(19182): Xaa can be any naturally occurring amino acid
  misc_feature (19184)..(19184): Xaa can be any naturally occurring amino acid
  misc_feature (19191)..(19191): Xaa can be any naturally occurring amino acid
  misc_feature (19194)..(19195): Xaa can be any naturally occurring amino acid
  misc_feature (19197)..(19197): Xaa can be any naturally occurring amino acid
  misc_feature (19207)..(19207): Xaa can be any naturally occurring amino acid
  misc_feature (19337)..(19338): Xaa can be any naturally occurring amino acid
  misc_feature (19340)..(19340): Xaa can be any naturally occurring amino acid
  misc_feature (19347)..(19347): Xaa can be any naturally occurring amino acid
  misc_feature (19350)..(19351): Xaa can be any naturally occurring amino acid
  misc_feature (19353)..(19353): Xaa can be any naturally occurring amino acid
  misc_feature (19363)..(19363): Xaa can be any naturally occurring amino acid
  misc_feature (19373)..(19374): Xaa can be any naturally occurring amino acid
  misc_feature (19376)..(19376): Xaa can be any naturally occurring amino acid
  misc_feature (19388)..(19389): Xaa can be any naturally occurring amino acid
  misc_feature (19398)..(19398): Xaa can be any naturally occurring amino acid
  misc_feature (19400)..(19401): Xaa can be any naturally occurring amino acid
  misc_feature (19403)..(19405): Xaa can be any naturally occurring amino acid
  misc_feature (19409)..(19409): Xaa can be any naturally occurring amino acid
  misc_feature (19413)..(19413): Xaa can be any naturally occurring amino acid
  misc_feature (19415)..(19415): Xaa can be any naturally occurring amino acid
  misc_feature (19421)..(19425): Xaa can be any naturally occurring amino acid
  misc_feature (19427)..(19428): Xaa can be any naturally occurring amino acid
  misc_feature (19439)..(19439): Xaa can be any naturally occurring amino acid
  misc_feature (19446)..(19446): Xaa can be any naturally occurring amino acid
  misc_feature (19448)..(19448): Xaa can be any naturally occurring amino acid
  misc_feature (19452)..(19452): Xaa can be any naturally occurring amino acid
  misc_feature (19456)..(19456): Xaa can be any naturally occurring amino acid
  misc_feature (19465)..(19465): Xaa can be any naturally occurring amino acid
  misc_feature (19468)..(19468): Xaa can be any naturally occurring amino acid
  misc_feature (19471)..(19471): Xaa can be any naturally occurring amino acid
  misc_feature (19477)..(19477): Xaa can be any naturally occurring amino acid
  misc_feature (19482)..(19482): Xaa can be any naturally occurring amino acid
  misc_feature (19484)..(19486): Xaa can be any naturally occurring amino acid
  misc_feature (19489)..(19489): Xaa can be any naturally occurring amino acid
  misc_feature (19493)..(19494): Xaa can be any naturally occurring amino acid
  misc_feature (19496)..(19496): Xaa can be any naturally occurring amino acid
  misc_feature (19503)..(19503): Xaa can be any naturally occurring amino acid
  misc_feature (19506)..(19507): Xaa can be any naturally occurring amino acid
  misc_feature (19509)..(19509): Xaa can be any naturally occurring amino acid
  misc_feature (19519)..(19519): Xaa can be any naturally occurring amino acid
  misc_feature (19649)..(19650): Xaa can be any naturally occurring amino acid
  misc_feature (19652)..(19652): Xaa can be any naturally occurring amino acid
  misc_feature (19659)..(19659): Xaa can be any naturally occurring amino acid
  misc_feature (19662)..(19663): Xaa can be any naturally occurring amino acid
  misc_feature (19665)..(19665): Xaa can be any naturally occurring amino acid
  misc_feature (19675)..(19675): Xaa can be any naturally occurring amino acid
  misc_feature (19685)..(19686): Xaa can be any naturally occurring amino acid
  misc_feature (19688)..(19688): Xaa can be any naturally occurring amino acid
  misc_feature (19700)..(19701): Xaa can be any naturally occurring amino acid
  misc_feature (19710)..(19710): Xaa can be any naturally occurring amino acid
  misc_feature (19712)..(19713): Xaa can be any naturally occurring amino acid
  misc_feature (19715)..(19717): Xaa can be any naturally occurring amino acid
  misc_feature (19721)..(19721): Xaa can be any naturally occurring amino acid
  misc_feature (19725)..(19725): Xaa can be any naturally occurring amino acid
  misc_feature (19727)..(19727): Xaa can be any naturally occurring amino acid
  misc_feature (19733)..(19737): Xaa can be any naturally occurring amino acid
  misc_feature (19739)..(19740): Xaa can be any naturally occurring amino acid
  misc_feature (19751)..(19751): Xaa can be any naturally occurring amino acid
  misc_feature (19758)..(19758): Xaa can be any naturally occurring amino acid
  misc_feature (19760)..(19760): Xaa can be any naturally occurring amino acid
  misc_feature (19764)..(19764): Xaa can be any naturally occurring amino acid
  misc_feature (19768)..(19768): Xaa can be any naturally occurring amino acid
  misc_feature (19777)..(19777): Xaa can be any naturally occurring amino acid
  misc_feature (19780)..(19780): Xaa can be any naturally occurring amino acid
  misc_feature (19783)..(19783): Xaa can be any naturally occurring amino acid
  misc_feature (19789)..(19789): Xaa can be any naturally occurring amino acid
  misc_feature (19794)..(19794): Xaa can be any naturally occurring amino acid
  misc_feature (19796)..(19798): Xaa can be any naturally occurring amino acid
  misc_feature (19801)..(19801): Xaa can be any naturally occurring amino acid
  misc_feature (19805)..(19806): Xaa can be any naturally occurring amino acid
  misc_feature (19808)..(19808): Xaa can be any naturally occurring amino acid
  misc_feature (19815)..(19815): Xaa can be any naturally occurring amino acid
  misc_feature (19818)..(19819): Xaa can be any naturally occurring amino acid
  misc_feature (19821)..(19821): Xaa can be any naturally occurring amino acid
  misc_feature (19831)..(19831): Xaa can be any naturally occurring amino acid
  misc_feature (19960)..(19961): Xaa can be any naturally occurring amino acid
  misc_feature (19963)..(19963): Xaa can be any naturally occurring amino acid
  misc_feature (19970)..(19970): Xaa can be any naturally occurring amino acid
  misc_feature (19973)..(19974): Xaa can be any naturally occurring amino acid
  misc_feature (19976)..(19976): Xaa can be any naturally occurring amino acid
  misc_feature (19986)..(19986): Xaa can be any naturally occurring amino acid
  misc_feature (19996)..(19997): Xaa can be any naturally occurring amino acid
  misc_feature (19999)..(19999): Xaa can be any naturally occurring amino acid
  misc_feature (20011)..(20012): Xaa can be any naturally occurring amino acid
  misc_feature (20021)..(20021): Xaa can be any naturally occurring amino acid
  misc_feature (20023)..(20024): Xaa can be any naturally occurring amino acid
  misc_feature (20026)..(20028): Xaa can be any naturally occurring amino acid
  misc_feature (20032)..(20032): Xaa can be any naturally occurring amino acid
  misc_feature (20036)..(20036): Xaa can be any naturally occurring amino acid
  misc_feature (20038)..(20038): Xaa can be any naturally occurring amino acid
  misc_feature (20044)..(20048): Xaa can be any naturally occurring amino acid
  misc_feature (20050)..(20051): Xaa can be any naturally occurring amino acid
  misc_feature (20062)..(20062): Xaa can be any naturally occurring amino acid
  misc_feature (20069)..(20069): Xaa can be any naturally occurring amino acid
  misc_feature (20071)..(20071): Xaa can be any naturally occurring amino acid
  misc_feature (20075)..(20075): Xaa can be any naturally occurring amino acid
  misc_feature (20079)..(20079): Xaa can be any naturally occurring amino acid
  misc_feature (20088)..(20088): Xaa can be any naturally occurring amino acid
  misc_feature (20091)..(20091): Xaa can be any naturally occurring amino acid
  misc_feature (20094)..(20094): Xaa can be any naturally occurring amino acid
  misc_feature (20100)..(20100): Xaa can be any naturally occurring amino acid
  misc_feature (20105)..(20105): Xaa can be any naturally occurring amino acid
  misc_feature (20107)..(20109): Xaa can be any naturally occurring amino acid
  misc_feature (20112)..(20112): Xaa can be any naturally occurring amino acid
  misc_feature (20116)..(20117): Xaa can be any naturally occurring amino acid
  misc_feature (20119)..(20119): Xaa can be any naturally occurring amino acid
  misc_feature (20126)..(20126): Xaa can be any naturally occurring amino acid
  misc_feature (20129)..(20130): Xaa can be any naturally occurring amino acid
  misc_feature (20132)..(20132): Xaa can be any naturally occurring amino acid
  misc_feature (20142)..(20142): Xaa can be any naturally occurring amino acid
  misc_feature (20272)..(20273): Xaa can be any naturally occurring amino acid
  misc_feature (20275)..(20275): Xaa can be any naturally occurring amino acid
  misc_feature (20282)..(20282): Xaa can be any naturally occurring amino acid
  misc_feature (20285)..(20286): Xaa can be any naturally occurring amino acid
  misc_feature (20288)..(20288): Xaa can be any naturally occurring amino acid
  misc_feature (20298)..(20298): Xaa can be any naturally occurring amino acid
  misc_feature (20308)..(20309): Xaa can be any naturally occurring amino acid
  misc_feature (20311)..(20311): Xaa can be any naturally occurring amino acid
  misc_feature (20323)..(20324): Xaa can be any naturally occurring amino acid
  misc_feature (20333)..(20333): Xaa can be any naturally occurring amino acid
  misc_feature (20335)..(20336): Xaa can be any naturally occurring amino acid
  misc_feature (20806)..(20808): Xaa can be any naturally occurring amino acid
  misc_feature (20812)..(20812): Xaa can be any naturally occurring amino acid
  misc_feature (20816)..(20816): Xaa can be any naturally occurring amino acid
  misc_feature (20818)..(20818): Xaa can be any naturally occurring amino acid
  misc_feature (20824)..(20828): Xaa can be any naturally occurring amino acid
  misc_feature (20830)..(20831): Xaa can be any naturally occurring amino acid
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTDTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWASVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPSTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGTSPAGTSPGSPEVSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLKDPEYAGHKLGIWDDFIPKFGKAAHMRELPLLSPPQDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVTWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPETVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAMANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSVAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHVILTTDEDTTAIEAMHPSTSTAATNVETTCSGHGSQSSVLTDSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSFGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSPLTPGQVKTTEVLDASAEPETSSPPSLSSTSVEILATSEVTTDTEKIHPFPNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLATSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLTPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSALPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISSEVITRLSTSPIKAESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILATTEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLATSKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMSSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRTHIPDSDQSTMSPDIITEVITRLSSSSMMSESTQMTITTQKSSPGATAQSTLTLATTTAPLARTHSTVPPRFLHSEMTTLMSRSPENPSWKSSPFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSTPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASRQMASTILTEMMITTPYVFPDVPETTSSLATSLGAETSTALPRTTPSVLNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPKTTPKFSHSKSDTTLPVAITSPGPEASSAVSTTTISPDMSDLVTSLVPSSGTDTSTTFPTLSETPYEPETTVTWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTGTSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTAAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLDREQLYWELSQLTNGIKELGPYTLDRNSLYVNGFTHWIPVPTSSTPGTSTVDLGSGTPSSLPSPTAAGPLLVPFTLNFTITNLQYEEDMHHPGSRKFNTTERVLQGLLGPMFKNTSVGLLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMRHPGSRKFNTTERVLQGLLKPLFKSTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNTTERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKHEAATGVDTICTHRVDPIGPGLDRERLYWELSQLTNSITELGPYTLDRDSLYVNGFNPRSSVPTTSTPGTSTVHLATSGTPSSLPGHTAPVPLLIPFTLNFTITNLHYEENMQHPGSRKFNTTERVLQGLLKPLFKNTSVGPLYSGCRLTLLRPEKHEAATGVDTICTHRVDPIGPGLXXEXLYWELSXLTXXIXELGPYTLDRXSLYVNGFTHXXSXPTTSTPGTSTVXXGTSGTPSSXPXXTSAGPLLVPFTLNFTITNLQYEEDMHHPGSRKFNTTERVLQGLLGPMFKNTSVGLLYSGCRLTLLRPEKNGAATGMDAICSHRLDPKSPGLDREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQSSMTTTRTPDTSTMHLATSRTPASLSGPTTASPLLVLFTINCTITNLQYEEDMRRTGSRKFNTMESVLQGLLKPLFKNTSVGPLYSGCRLTLLRPKKDGAATGVDAICTHRLDPKSPGLNREQLYWELSKLTNDIEELGPYTLDRNSLYVNGFTHQSSVSTTSTPGTSTVDLRTSGTPSSLSSPTIMXXXPLLXPFTXNXTITNLXXXXXMXXPGSRKFNTTERVLQGLLRPLFKNTSVSSLYSGCRLTLLRPEKDGAATRVDAACTYRPDPKSPGLDREQLYWELSQLTHSITELGPYTLDRVSLYVNGFNPRSSVPTTSTPGTSTVHLATSGTPSSLPGHTXXXPLLXPFTXNXTITNLXXXXXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSGLTTSTPWTSTVDLGTSGTPSPVPSPTTAGPLLVPFTLNFTITNLQYEEDMHRPGSRRFNTTERVLQGLLTPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFSTTERVLQGLLKPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTTLRPKKDGAATKVDAICTYRPDPKSPGLDREQLYWELSQLTHSITELGPYTQDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRTSVPTTSTPGTSTVDLGTSGTPFSLPSPAXXXPLLXPFTXNXTITNLXXXXXMXXPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTSLRSEKDGAATGVDAICTHRVDPKSPGVDREQLYWELSQLTNGIKELGPYTLDRNSLYVNGFTHQTSAPNTSTPGTSTVXXGTSGTPSSXPXXTSAGPLLVPFTLNFTITNLQYEEDMHHPGSRKFNTTERVLQGLLGPMFKNTSVGLLYSGCRLTLLRPEKNGATTGMDAICTHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTERVLQGLLKPLFRNSSLEYLYSGCRLASLRPEKDSSAMAVDAICTHRPDPEDLGLDRERLYWELSNLTNGIQELGPYTLDRNSLYVNGFTHRSSMPTTSTPGTSTVDVGTSGTPSSSPSPTTAGPLLIPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTERVLQGLLRPVFKNTSVGPLYSGCRLTLLRPKKDGAATKVDAICTYRPDPKSPGLDREQLYWELSQLTHSITELGPYTQDRDSLYVNGFTHRSSVPTTSIPGTSAVHLETTGTPSSFPGHTEPGPLLIPFTFNFTITNLRYEENMQHPGSRKFNTTERVLQGLLTPLFKNTSVGPLYSGCRLTLLRPEKQEAATGVDTICTHRVDPIGPGLDRERLYWELSQLTNSITELGPYTLDRDSLYVDGFNPWSSVPTTSTPGTSTVHLATSGTPSPLPGHTAPVPLLIPFTLNFTITDLHYEENMQHPGSRKFNTTERVLQGLLKPLFKSTSVGPLYSGCRLTLLRPEKHGAATGVDAICTLRLDPTGPGLDRERLYWELSQLTNSITELGPYTLDRDSLYVNGFNPWSSVPTTSTPGTSTVHLATSGTPSSLPGHTTAGPLLVPFTLNFTITNLKYEEDMHCPGSRKFNTTERVLQSLHGPMFKNTSVGPLYSGCRLTLLRSEKDGAATGVDAICTHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTNSITELGPYTLDRDSLYVNGFTHRSSMPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFHPRSSVPTTSTPGTSTVHLATSGTPSSLPGHTAPVPLLIPFTLNFTITNLHYEENMQHPGSRKFNTTERVLQGLLGPMFKNTSVGLLYSGCRLTLLRPEKNGAATGMDAICSHRLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHQNSVPTTSTPGTSTVYWATTGTPSSFPGHTEPGPLLIPFTFNFTITNLHYEENMQHPGSRKFNTTERVLQGLLTPLFKNTSVGPLYSGCRLTLLRPEKQEAATGVDTICTHRVDPIGPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHRSSVPTTSSPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHRTSVPTTSTPGTSTVHLATSGTPSSLPGHTAPVPLLIPFTLNFTITNLQYEEDMHRPGSRKFNTTERVLQGLLSPIFKNSSVGPLYSGCRLTSLRPEKDGAATGMDAVCLYHPNPKRPGLDREQLYCELSQLTHNITELGPYSLDRDSLYVNGFTHQNSVPTTSTPGTSTVYWATTGTPSSFPGHTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHWSSGLTTSTPWTSTVDLGTSGTPSPVPSPTTAGPLLVPFTLNFTITNLQYEEDMHRPGSRKFNATERVLQGLLSPIFKNTSVGPLYSGCRLTLLRPEKQEAATGVDTICTHRVDPIGPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHRSFGLTTSTPWTSTVDLGTSGTPSPVPSPTTAGPLLVPFTLNFTITNLQYEEDMHRPGSRKFNTTERVLQGLLTPLFRNTSVSSLYSGCRLTLLRPEKDGAATRVDAVCTHRPDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHWIPVPTSSTPGTSTVDLGSGTPSSLPSPTTAGPLLVPFTLNFTITNLQYGEDMGHPGSRKFNTTERVLQGLLGPIFKNTSVGPLYSGCRLTSLRSEKDGAATGVDAICIHHLDPKSPGLXXEXLYWELSXLTXXIXELGPYTLDRXSLYVNGFTHXXSXPTTSTPGTSTVXXGTSGTPSSXPXXTXXXPLLXPFTXNXTITNLXXXXXMXXPGSRKFNTTEXVLQGLLXPXFKNXSVGXLYSGCRLTXLRXEKXGAATGXDAICXHXXXPKXPGLXXEXLYWELSXLTXXIXELGPYTLDRXSLYVNGFTHQTFAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATRVDAVCTHRPDPKSPGLXXEXLYWELSXLTXXIXELGPYTLDRXSLYVNGFTHXXSXPTTSTPGTSTVXXGTSGTPSSXPXXTAPVPLLIPFTLNFTITNLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTQRSSVPTTSIPGTSAVHLETSGTPASLPGHTAPGPLLVPFTLNFTITNLQYEVDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTXXXPLLXPFTXNXTITNLXXXXXMXXPGSRKFNTTERVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGHYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGSRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMKHLLSPLFQRSSLGARYTGCRVIALRSVKNGAETRVDLLCTYLQPLSGPGLPIKQVFHELSQQTHGITRLGPYSLDKDSLYLNGYNEPGLDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 1221 - protein, 889 aa, Homo sapiens
MEGGLADGEPDRTSLLGDSKDVLGPSTVVANSDESQLLTPGKMSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLIYKTQKNGQWVGTVLLNACEIIERPSKKDGFCFKLFHPLEQSIWAVKGPKGEAVGSITQPLPSSYLIIRATSESDGRCWMDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARDRKTKNEEWSCKLFELDPLTGEWHYKFADTRPWDPLNDMIQFEKDGVIQTKVKHRTPMVSVPKMKHKPTRQQKKVAKGYSSPEPDIQDSSGSEAQSVKPSTRRKKGIELGDIQSSIESIKQTQEEIKRNIMALRNHLVSSTPATDYFLQQKDYFIIFLLILLQVIINFMFK

SEQ ID NO: 1222 - protein, 597 aa, Homo sapiens
MFPVAPKPQDSSQPSDRLMTEKQQEEAEWESINVLLMMHGLKPLSLVKRTDLKDLIIFDKQSSQRMRQNLKLLVEETSCQQNMIQELIETNQQLRNELQLEQSRAANQEQRANDLEQIMESVKSKIGELEDESLSRACHQQNKIKDLQKEQKTLQVKCQHYKKKRTEQEETIASLQMEVCRLKKEEEDRIVTQNRVFAYLCKRVPHTVLDRQLLCLIDYYESKIRKIHTQRQYKEDESQSEEENDYRNLDASPTYKGLLMSLQNQLKESKSKIDALSSEKLNLQKDLETRPTQHELRLYKQQVKKLEKALKKNVKLQELINHKKAEDTEKKDEPSKYNQQQALIDQRYFQVLCSINSIIHNPRAPVIIYKQTKGGVQNFNKDLVQDCGFEHLVPVIEMWADQLTSLKDLYKSLKTLSAELVPWLNLKKQDENEGIKVEDLLFIVDTMLEEVENKEKDSNMPHFQTLQAIVSHFQKLFDVPSLNGVYPRMNEVYTRLGEMNNAVRNLQELLELDSSSSLCVLVSTVGKLCRLINEDVNEQVMQVLGPEDLQSIIYKLEEHEEFFPAFQAFTNDLLEILEIDDLDAIVPAVKKLKVLSY

SEQ ID NO: 1223 - protein, 686 aa, Homo sapiens
MGPRSRERRAGAVQNTNDSSALSKRSLAARGYVQDPFAALLVPGAARRAPLIHRGYYVRARAVRHCVRAFLEQIGAPQAALRAQILSLGAGFDSLYFRLKTAGRLARAAVWEVDFPDVARRKAERIGETPELCALTGPFERGEPASALCFESADYCILGLDLRQLQRVEEALGAAGLDAASPTLLLAEAVLTYLEPESAAALIAWAAQRFPNALFVVYEQMRPQDAFGQFMLQHFRQLNSPLHGLERFPDVEAQRRRFLQAGWTACGAVDMNEFYHCFLPAEERRRVENIEPFDEFEEWHLKCAHYFILAASRGDTLSHTLVFPSSEAFPRVNPASPSGVFPASVVSSEGQVPNLKRYGHASVFLSPDVILSAGGFGEQEGRHCRVSQFHLLSRDCDSEWKGSQIGSCGTGVQWDGRLYHTMTRLSESRVLVLGGRLSPVSPALGVLQLHFFKSEDNNTEDLKVTITKAGRKDDSTLCCWRHSTTEVSCQNQEYLFVYGGRSVVEPVLSDWHFLHVGTMAWVRIPVEGEVPEARHSHSACTWQGGALIAGGLGASEEPLNSVLFLRPISCGFLWESVDIQPPITPRYSHTAHVLNGKLLLVGGIWIHSSSFPGVTVINLTTGLSSEYQIDTTYVPWPLMLHNHTSILLPEEQQLLLLGGGGNCFSFGTYFNPHTVTLDLSSLSAGQ

SEQ ID NO: 1224 - protein, 691 aa, Homo sapiens
MAPFPEEVDVFTAPHWRMKQLVGLYCDKLSKTNFSNNNDFRALLQSLYATFKEFKMHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKEAEVSEHSTGITHLPPEVMLSIFSYLNPQELCRCSQVSMKWSQLTKTGSLWKHLYPVHWARGDWYSGPATELDTEPDDEWVKNRKDESRAFHEWDEDADIDESEESAEESIAISIAQMEKRLLHGLIHNVLPYVGTSVKTLVLAYSSAVSSKMVRQILELCPNLEHLDLTQTDISDSAFDSWSWLGCCQSLRHLDLSGCEKITDVALEKISRALGILTSHQSGFLKTSTSKITSTAWKNKDITMQSTKQYACLHDLTNKGIGEEIDNEHPWTKPVSSENFTSPYVWMLDAEDLADIEDTVEWRHRNVESLCVMETASNFSCSTSGCFSKDIVGLRTSVCWQQHCASPAFAYCGHSFCCTGTALRTMSSLPESSAMCRKAARTRLPRGKDLIYFGSEKSDQETGRVLLFLSLSGCYQITDHGLRVLTLGGGLPYLEHLNLSGCLTITGAGLQDLVSACPSLNDEYFYYCDNINGPHADTASGCQNLQCGFRACCRSGE

SEQ ID NO: 1225 - protein, 418 aa, Homo sapiens
MLYLEDYLEMIEQLPMDLRDRFTEMREMDLQVQNAMDQLEQRVSEFFMNAKKNKPEWREEQMASIKKDYYKALEDADEKVQLANQIYDLVDRHLRKLDQELAKFKMELEADNAGITEILERRSLELDTPSQPVNNHHAHSHTPVEKRKYNPTSHHTTTDHIPEKKFKSEALLSTLTSDASKENTLGCRNNNSTASSNNAYNVNSSQPLGSYNIGSLSSGTGAGAITMAAAQAVQATAQMKEGRRTSSLKASYEAFKNNDFQLGKEFSMARETVGYSSSSALMTTLTQNASSSAADSRSGRKSKNNNKSSSQQSSSSSSSSSLSSCSSSSTVVQEISQQTTVVPESDSNSQVDWTYDPNEPRYCICNQVSYGEMVGCDNQDCPIEWFHYGCVGLTEAPKGKWYCPQCTAAMKRRGSRHK

SEQ ID NO: 1226 - protein, 1253 aa, Homo sapiens
MTTHVTLEDALSNVDLLEELPLPDQQPCIEPPPSSIMYQANFDTNFEDRNAFVTGIARYIEQATVHSSMNEMLEEGHEYAVMLYTWRSCSRAIPQVKCNEQPNRVEIYEKTVEVLEPEVTKLMKFMYFQRKAIERFCSEVKRLCHAERRKDFVSEAYLLTLGKFINMFAVLDELKNMKCSVKNDHSAYKRAAQFLRKMADPQSIQESQNLSMFLANHNRITQCLHQQLEVIPGYEELLADIVNICVDYYENKMYLTPSEKHMLLKVMGFGLYLMDGNVSNIYKLDAKKRINLSKIDKFFKQLQVVPLFGDMQIELARYIKTSAHYEENKSKWTCTQSSISPQYNICEQMVQIRDDHIRFISELARYSNSEVVTGSGLDSQKSDEEYRELFDLALRGLQLLSKWSAHVMEVYSWKLVHPTDKFCNKDCPGTAEEYERATRYNYTSEEKFAFVEVIAMIKGLQVLMGRMESVFNQAIRNTIYAALQDFAQVTLREPLRQAVRKKKNVLISVLQAIRKTICDWEGGREPPNDPCLRGEKDPKGGFDIKVPRRAVGPSSTQLYMVRTMLESLIADKSGSKKTLRSSLDGPIVLAIEDFHKQSFFFTHLLNISEALQQCCDLSQLWFREFFLELTMGRRIQFPIEMSMPWILTDHILETKEPSMMEYVLYPLDLYNDSAYYALTKFKKQFLYDEIEAEVNLCFDQFVYKLADQIFAYYKAMAGSVLLDKRFRAECKNYGVIIPYPPSNRYETLLKQRHVQLLGRSIDLNRLITQRISAAMYKSLDQAISRFESEDLTSIVELEWLLEINRLTHRLLCKHMTLDSFDAMFREANHNVSAPYGRITLHVFWELNFDFLPNYCYNGSTNRFVRTAIPFTQEPQRDKPANVQPYYLYGSKPLNIAYSHIYSSYRNFVGPPHFKTICRLLGYQGIAVVMEELLKIVKSLLQGTILQYVKTLIEVMPKICRLPRHEYGSPGILEFFHHQLKDIIEYAELKTDVFQSLREVGNAILFCLLIEQALSQEEVCDLLHAAPFQNILPRVYIKEGERLEVRMKRLEAKYAPLHLVPLIERLGTPQQIAIAREGDLLTKERLCCGLSMFEVILTRIRSYLQDPIWRGPPPTNGVMHVDECVEFHRLWSAMQFVYCIPVGTNEFTAEQCFGDGLNWAGCSIIVLLGQQRRFDLFDFCYHLLKVQRQDGKDEIIKNVPLKKMADRIRKYQILNNEVFAILNKYMKSVETDSSTVEHVRCFQPPIHQSLATTC

SEQ ID NO: 1227 - protein, 1462 aa, Homo sapiens
MAPVHGDDSLSDSGSFVSSRARREKKSKKGRQEALERLKKAKAGEKYKYEVEDFTGVYEEVDEEQYSKLVQARQDDDWIVDDDGIGYVEDGREIFDDDLEDDALDADEKGKDGKARNKDKRNVKKLAVTKPNNIKSMFIACAGKKTADKAVDLSKDGLLGDILQDLNTETPQITPPPVMILKKKRSIGASPNPFSVHTATAVPSGKIASPVSRKEPPLTPVPLKRAEFAGDDVQVESTEEEQESGAMEFEDGDFDEPMEVEEVDLEPMAAKAWDKESEPAEEVKQEADSGKGTVSYLGSFLPDVSCWDIDQEGDSSFSVQEVQVDSSHLPLVKGADEEQVFHFYWLDAYEDQYNQPGVVFLFGKVWIESAETHVSCCVMVKNIERTLYFLPREMKIDLNTGKETGTPISMKDVYEEFDEKIATKYKIMKFKSKPVEKNYAFEIPDVPEKSEYLEVKYSAEMPQLPQDLKGETFSHVFGTNTSSLELFLMNRKIKGPCWLEVKSPQLLNQPVSWCKVEAMALKPDLVNVIKDVSPPPLVVMAFSMKTMQNAKNHQNEIIAMAALVHHSFALDKAAPKPPFQSHFCVVSKPKDCIFPYAFKEVIEKKNVKVEVAATERTLLGFFLAKVHKIDPDIIVGHNIYGFELEVLLQRINVCKAPHWSKIGRLKRSNMPKLGGRSGFGERNATCGRMICDVEISAKELIRCKSYHLSELVQQILKTERVVIPMENIQNMYSESSQLLYLLEHTWKDAKFILQIMCELNVLPLALQITNIAGNIMSRTLMGGRSERNEFLLLHAFYENNYIVPDKQIFRKPQQKLGDEDEEIDGDTNKYKKGRKKAAYAGGLVLDPKVGFYDKFILLLDFNSLYPSIIQEFNICFTTVQRVASEAQKVTEDGEQEQIPELPDPSLEMGILPREIRKLVERRKQVKQLMKQQDLNPDLILQYDIRQKALKLTANSMYGCLGFSYSRFYAKPLAALVTYKGREILMHTKEMVQKMNLEVIYGDTDSIMINTNSTNLEEVFKLGNKVKSEVNKLYKLLEIDIDGVFKSLLLLKKKKYAALVVEPTSDGNYVTKQELKGLDIVRRDWCDLAKDTGNFVIGQILSDQSRDTIVENIQKRLIEIGENVLNGSVPVSQFEINKALTKDPQDYPDKKSLPHVHVALWINSQGGRKVKAGDTVSYVICQDGSNLTASQRAYAPEQLQKQDNLTIDTQYYLAQQIHPVVARICEPIDGIDAVLIATWLGLDPTQFRVHHYHKDEENDALLGGPAQLTDEEKYRDCERFKCPCPTCGTENIYDNVFDGSGTDMEPSLYRCSNIDCKASPLTFTVQLSNKLIMDIRRFIKKYYDGWLICEEPTCRNRTRHLPLQFSRTGPLCPACMKATLQPEYSDKSLYTQLCFYRYIFDAECALEKLTTDHEKDKLKKQFFTPKVLQDYRKLKNTAEQFLSRSGYSEVNLSKLFAGCAVKS

SEQ ID NO: 1228 - protein, 252 aa, Homo sapiens
ALSMPLNGLKEEDKEPLIELFVKAGSDGESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 1229 - protein, 314 aa, Homo sapiens
MYKMEYSYLNSSAYESCMAGMDTSSLASAYADFSSCSQASGFQYNPIRTTFGATSGCPSLTPGSCSLGTLRDHQSSPYAAVPYKLFTDHGGLNEKRKQRRIRTTFTSAQLKELERVFAETHYPDIYTREELALKIDLTEARVQVWFQNRRAKFRKQERAAAAAAAAAKNGSSGKKSDSSRDDESKEAKSTDPDSTGGPGPNPNPTPSCGANGGGGGGPSPAGAPGAAGPGGPGGEPGKGGAAAAAAAAAAAAAAAAAAAAGGLAAAGGPGQGWAPGPGPITSIPDSLGGPFGSVLSSLQRPNGAKAALVKSSMF

SEQ ID NO: 1230 - protein, 309 aa, Homo sapiens
MLLILLSVALLALSSAQSLNEDVSQEESPSVISGKPEGRRPQGGNQPQRTPPPPGKPEGRPPQGGNQSQGPPPRPGKPEGPPPQGGNQSQGPPPRPGKPEGQPPQGGNQSQGPPPRPGKPEGPPPQGGNQSQGPPPRPGKPEGPPPQGGNQSQGPPPHPGKPEGPPPQGGNQSQGPPPRPGKPEGPPPQGGNQSQGPPPRPGKPEGPPPQGGNQSQGPPPRPGKPEGSPSQGGNKPQGPPPHPGKPQGPPPQEGNKPQRPPPPGRPQGPPPPGGNPQQPLPPPAGKPQGPPPPPQGGRPHRPPQGQPPQ

SEQ ID NO: 1231 - protein, 1447 aa, Homo sapiens
MASAGNAAEPQDRGGGGSGCIGAPGRPAGGGRRRRTGGLRRAAAPDRDYLHRPSYCDAAFALEQISKGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPLYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 1232 - protein, 1499 aa, Homo sapiens
MKPLAIPANHGVMGQQEKHSLPADFTKLHLTDSLHPQVTHVSSSHSGCSITSDSGSSSLSDIYQATESEAGDMDLSGLPETAVDSEDDDDEEDIERASDPLMSRDIVRDCLEKDPIDRTDDDIEQLLEFMHQLPAFANMTMSVRRELCAVMVFAVVERAGTIVLNDGEELDSWSVILNGSVEVTYPDGKAEILCMGNSFGVSPTMDKEYMKGVMRTKVDDCQFVCIAQQDYCRILNQVEKNMQKVEEEGEIVMVKEHRELDRTGTRKGHIVIKGTSERLTMHLVEEHSVVDPTFIEDFLLTYRTFLSSPMEVGKKLLEWFNDPSLRDKVTRVVLLWVNNHFNDFEGDPAMTRFLEEFENNLEREKMGGHLRLLNIACAAKAKRRLMTLTKPSREAPLPFILLGGSEKGFGIFVDSVDSGSKATEAGLKRGDQILEVNGQNFENIQLSKAMEILRNNTHLSITVKTNLFVFKELLTRLSEEKRNGAPHLPKIGDIKKASRYSIPDLAVDVEQVIGLEKVNKKSKANTVGGRNKLKKILDKTRISILPQKPYNDIGIGQSQDDSIVGLRQTKHIPTALPVSGTLSSSNPDLLQSHHRILDFSATPDLPDQVLRVFKADQQSRYIMISKDTTAKEVVIQAIREFAVTATPDQYSLCEVSVTPEGVIKQRRLPDQLSKLADRIQLSGRYYLKNNMETETLCSDEDAQELLRESQISLLQLSTVEVATQLSMRNFELFRNIEPTEYIDDLFKLRSKTSCANLKRFEEVINQETFWVASEILRETNQLKRMKIIKHFIKIALHCRECKNFNSMFAIISGLNLAPVARLRTTWEKLPNKYEKLFQDLQDLFDPSRNMAKYRNVLNSQNLQPPIIPLFPVIKKDLTFLHEGNDSKVDGLVNFEKLRMIAKEIRHVGRMASVNMDPALMFRTRKKKWRSLGSLSQGSTNATVLDVAQTGGHKKRVRRSSFLNAKKLYEDAQMARKVKQYLSNLELEMDEESLQTLSLQCEPATNTLPKNPGDKKPVKSETSPVAPRAGSQQKAQSLPQPQQQPPPAHKINQGLQVPAVSLYPSRKKVPVKDLPPFGINSPQALKKILSLSEEGSLERHKKQAEDTISNASSQLSSPPTSPQSSPRKGYTLAPSGTVDNFSDSGHSEISSRSSIVSNSSFDSVPVSLHDERRQRHSVSIVETNLGMGRMERRTMIEPDQYSLGSYAPMSEGRGLYATATVISSPSTEELSQDQGDRASLDAADSGRGSWTSCSSGSHDNIQTIQHQRSWETLPFGHTHFDYSGDPAGLWASSSHMDQIMFSDHSTKYNRQNQSRESLEQAQSRASWASSTGYWGEDSEGDTGTIKRRGGKDVSIEAESSSLTSVTTEETKPVPMPAHIAVASSTTKGLIARKEGRYREPPPTPPGYIGIPITDFPEGHSHPARKPPDYNVALQRSRMVARSSDTAGPSSVQQPHGHPTSSRPVNKPQWHKPNESDPRLAPYQSQGFSTEEDEDEQVSAV

SEQ ID NO: 1233 - protein, 2341 aa, Homo sapiens
MGSQTLQILRQGVWAALSGGWYYDPHQATFVNALHLYLWLFLLGLPFTLYMALPSTMIIVAVYCPVIAAVFIVLKMVNYRLHRALDAGEVVDRTANEFTDQRTKAEQGNCSTRRKDSNGPSDPGGGIEMSEFIREATPPVGCSSRNSYAGLDPSNQIGSGSSRLGTAATIKGDTDTAKTSDDISLSLGQSSSLCKEGSEEQDLAADRKLFRLVSNDSFISIQPSLSSCGQDLPRDFSDKVNLPSHNHHHHVDQSLSSACDTEVASLVPLHSHSYRKDHRPRGVPRTSSSAVAFPDTSLNDFPLYQQRRGLDPVSELESSKPLSGSKESLVENSGLSGEFQLAGDLKINTSQPPTKSGKSKPLKAEKSMDSLRSLSTRSSGSTESYCSGTDRDTNSTVSSYKSEQTSSTHIESILSEHEESPKAGTKSGRKKECCAGPEEKNSCASDKRTSSEKIAMEASTNSGVHEAKDPTPSDEMHNQRGLSTSASEEANKNPHANEFTSQGDRPPGNTAENKEEKSDKSAVSVDSKVRKDVGGKQKEGDVRPKSSSVIHRTASAHKSGRRRTGKKRASSFDSSRHRDYVCFRGVSGTKPHSAIFCHDEDSSDQSDLSRASSVQSAHQFSSDSSSSTTSHSCQSPEGRYSALKTKHTHKERGTDSEHTHKAHLVPEGTSKKRATRRTSSTNSAKTRARVLSLDSGTVACLNDSNRLMAPESIKPLTTSKSDLEAKEGEVLDELSLLGRASQLETVTRSRNSLPNQVAFPEGEEQDAVSGAAQASEEAVSFRRERSTFRRQAVRRRHNAGSNPTPPTLLIGSPLSLQDGQQGQQSTAQVKVQSRPPSQAAVLSASASLLVRNGSVHLEASHDNASAVGGSSLHDELGKFSSTLYETGGCDMSLVNFEPAARRASNICDTDSHVSSSTSVRFYPHDVLSLPQIRLNRLLTIDTDLLEQQDIDLSPDLAATYGPTEEAAQKVKHYYRFWILPQLWIGINFDRLTLLALFDRNREILENVLAVILAILVAFLGSILLIQGFFRDIWVFQFCLVIASCQYSLLKSVQPDSSSPRHGHNRIIAYSRPVYFCICCGLIWLLDYGSRNLTATKFKLYGITFTNPLVFISARDLVIVFTLCFPIVFFIGLLPQVNTFVMYLCEQLDIHIFGGNATTSLLAALYSFICSIVAVALLYGLCYGALKDSWDGQHIPVLFSIFCGLLVAVSYHLSRQSSDPSVLFSLVQSKIFPKTEEKNPEDPLSEVKDPLPEKLRNSVSERLQSDLVVCIVIGVLYFAIHVSTVFTVLQPALKYVLYTLVGFVGFVTHYVLPQVRKQLPWHCFSHPLLKTLEYNQYEVRNAATMMWFEKLHVWLLFVEKNIIYPLIVLNELSSSAETIASPKKLNTELGALMITVAGLKLLRSSFSSPTYQYVTVIFTVLFFKFDYEAFSETMLLDLFFMSILFNKLWELLYKLQFVYTYIAPWQITWGSAFHAFAQPFAVPHSAMLFIQAAVSAFFSTPLNPFLGSAIFITSYVRPVKFWERDYNTKRVDHSNTRLASQLDRNPGSDDNNLNSIFYEHLTRSLQHSLCGDLLLGRWGNYSTGDCFILASDYLNALVHLIEIGNGLVTFQLRGLEFRGTYCQQREVEAITEGVEEDEGFCCCEPGHIPHMLSFNAAFSQRWLAWEVIVTKYILEGYSITDNSAASMLQVFDLRKVLTTYYVKGIIYYVTTSSKLEEWLANETMQEGLRLCADRNYVDVDPTFNPNIDEDYDHRLAGISRESFCVIYLNWIEYCSSRRAKPVDVDKDSSLVTLCYGLCVLGRRALGTASHHMSSNLESFLYGLHALFKGDFRISSIRDEWIFADMELLRKVVVPGIRMSIKLHQDHFTSPDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNAKQALRNMINSSCDQPIGYPIFVSPLTTSYSDSHEQLKDILGGPISLGNIRNFIVSTWHRLRKGCGAGCNSGGNIEDSDTGGGTSCTGNNATTANNPHSNVTQGSIGNPGQGSGTGLHPPVTSYPPTLGTSHSSHSVQSGLVRQSPARASVASQSSYCYSSRHSSLRMSTTGFVPCRRSSTSQISLRNLPSSIQSRLSMVNQMEPSGQSGLACVQHGLPSSSSSSQSIPACKHHTLVGFLATEGGQSSATDAQPGNTLSPANNSHSKKAEVIYRVQIVDPSQILEGINLSKRKELQWPDEGIRLKAGRNSWKDWSPQEGMEGHVIHRWVPCSRDPGTRSHIDKAVLLVQIDDKYVTVIETGVLELGAEV

SEQ ID NO: 1234 - protein, 984 aa, Homo sapiens
MAGNDCGALLDEELSSFFLNYLADTQGGGSGEEQLYADFPELDLSQLDASDFDSATCFGELQWCPENSETEPNQYSPDDSELFQIDSENEALLAELTKTLDDIPEDDVGLAAFPALDGGDALSCTSASPAPSSAPPSPAPEKPSAPAPEVDELSLADSTQDKKAPMMQSQSRSCTELHKHLTSAQCCLQDRGLQPPCLQSPRLPAKEDKEPGEDCPSPQPAPASPRDSLALGRADPGAPVSQEDMQAMVQLIRYMHTYCLPQRKLPPQTPEPLPKACSNPSQQVRSRPWSRHHSKASWAEFSILRELLAQDVLCDVSKPYRLATPVYASLTPRSRPRPPKDSQASPGRPSSVEEVRIAASPKSTGPRPSLRPLRLEVKREVRRPARLQQQEEEDEEEEEEEEEEEKEEEEEWGRKRPGRGLPWTKLGRKLESSVCPVRRSRRLNPELGPWLTFADEPLVPSEPQGALPSLCLAPKAYDVERELGSPTDEDSGQDQQLLRGPQIPALESPCESGCGDMDEDPSCPQLPPRDSPRCLMLALSQSDPTFGKKSFEQTLTVELCGTAGLTPPTTPPYKPTEEDPFKPDIKHSLGKEIALSLPSPEGLSLKATPGAAHKLPKKHPERSELLSHLRHATAQPASQAGQKRPFSCSFGDHDYCQVLRPEGVLQRKVLRSWEPSGVHLEDWPQQGAPWAEAQAPGREEDRSCDAGAPPKDSTLLRDHEIRASLTKHFGLLETALEEEDLASCKSPEYDTVFEDSSSSSGESSFLPEEEEEEGEEEEEDDEEEDSGVSPTCSDHCPYQSPPSKANRQLCSRSRSSSGSSPCHSWSPATRRNFRCESRGPCSDRTPSIRHARKRREKAIGEGRVVYIQNLSSDMSSRELKRRFEVFGEIEECEVLTRNRRGEKYGFITYRCSEHAALSLTKGAALRKRNEPSFQLSYGGLRHFCWPRYTDYDSNSEEALPASGKSKYEAMDFDSLLKEAQQSLH

SEQ ID NO: 1235 - protein, 404 aa, Homo sapiens
MFTEKTTTYQYPRAILSVDLSGENLSDVDFLDDSSTESLLLSGDEYNQDFDSTNFEESQDEDDALNEIVRCICEMDEENGFMIQCEECLCWQHSVCMGLLEESIPEQYICYICRDPPGQRWSAKYRYDKEWLNNGRMCGLSFFKENYSHLNAKKIVSTHHLLADVYGVTEVLHGLQLKIGILKNKHHPDLHLWACSGKRKDQDQIIAGVEKKIAQDTVNREEKKYVQNHKEPPRLPLKMEGTYITSEHSYQKPQSFGQDCKSLADPGSSDDDDVSSLEEEQEFHMRSKNSLQYSAKEHGMPEKNPAEGNTVFVYNDKKGTEDPGDSHLQWQLNLLTHIENVQNEVTSRMDLIEKEVDVLESWLDFTGELEPPDPLARLPQLKRHIKQLLIDMGKVQQIATLCSV

SEQ ID NO: 1236 - protein, 621 aa, Homo sapiens
PVSRVFSIHSSKPPDASYVPCTMLVLVIRGPYPSAQCQGKLMENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRKGGALKKGAIARTLQAVKMVLSYQPGELEWDSPHRTNQQQCYCYCGGPGEWYLRMLQCYRCRQWFHEACTQCLNEPMMFGDRFYLFFCSVCNQGPEYIERLPLRWVDVVHLALYNLGVQSKKKYFDFEEILAFVNHHWELLQLGKLTSTPVTDRGPHLLNALNSYKSRFLCGKEIKKKKCIFRLRIRVPPNPPGKLLPDKGLLPNENSASSELRKRGKSKPGLLPHEFQQQKRRVYRRKRSKFLLEDAIPSSDFTSAWSTNHHLASIFDFTLDEIQSLKSASSGQTFFSDVDSTDAASTSGSASTSLSYDSRWTVGSRKRKLAAKAYMPLRAKRWAAELDGRCPSDSSAEGASVPERPDEGIDSHTFESISEDDSSLSHLKSSITNYFGAAGRLACGEKYQVLARRVTPEGKVQYLVEWEGTTPY

SEQ ID NO: 1237 - protein, 1070 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKGLHEFDSLKDPEVNEFRRKMRKFSEEKILSLVGLSWMDWLKQTYPPEHEPSIPENLEDKLYGGKLIVAVHFENCQDVFSFQVSPNMNPIKVNELAIQKRLTIHGKEDEVSPYDYVLQVSGRVEYVFGDHPLIQFQYIRNCVMNRALPHFILVECCKIKKMYEQEMIAIEAAINRNSSNLPLPLPPKKTRIISHVWENNNPFQIVLVKGNKLNTEETVKVHVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKIIEKAAEIASSDSANVSSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 1238 - protein, 829 aa, Homo sapiens [sequence omitted]

SEQ ID NO: 1239 - protein, 3657 aa, Homo sapiens
MSRRAPGSRLSSGGTNYSRSWNDWQPRTDSASADPGNLKYSSSRDRGGSSSYGLQPSNSAVVSRQRHDDTRVHADIQNDEKGGYSVNGGSGENTYGRKSLGQELRVNNVTSPEFTSVQHGSRALATKDMRKSQERSMSYSDESRLSNLLRRITREDDRDRRLATVKQLKEFIQQPENKLVLVKQLDNILAAVHDVLNESSKLLQELRQEGACCLGLLCASLSYEAEKIFKWIFSKFSSSAKDEVKLLYLCATYKALETVGEKKAFSSVMQLVMTSLQSILENVDTPELLCKCVKCILLVARCYPHIFSTNFRDTVDILVGWHIDHTQKPSLTQQVSGWLQSLEPFWVADLAFSTTLLGQFLEDMEAYAEDLSHVASGESVDEDVPPPSVSLPKLAALLRVFSTVVRSIGERFSPIRGPPITEAYVTDVLYRVMRCVTAANQVFFSEAVLTAANECVGVLLGSLDPSMTIHCDMVITYGLDQLENCQTCGTDYIISVLNLLTLIVEQINTKLPSSFVEKLFIPSSKLLFLRYHKEKEVVAVAHAVYQAVLSLKNIPVLETAYKLILGEMTCALNNLLHSLQLPEACSEIKHEAFKNHVFNVDNAKFVVKFDLSALTTIGNAKNSLIGMWALSPTVFALLSKNLMIVHSDLAVHFPAIQYAVLYTLYSHCTRHDHFISSSLSSASPSLFDGAVISTVTTATKKHFSIILNLLGILLKKDNLNQDTRKLLMTWALEAAVLMRKSETYAPLFSLPSFHKFCKGLLANTLVEDVNICLQACSSLHALSSSLPDDLLQRCVDVCRVQLVHSGTRIRQAFGKLLKSIPLDVVLSNNNHTEIQEISLALRSHMSKAPSNTFHPQDFSDVISFILYGNSHRTGKDNWLERLFYSCQRLDKRDQSTIPRNLLKTDAVLWQWAIWEAAQFTVLSKLRTPLGRAQDTFQTIEGIIRSLAAHTLNPDQDVSQWTTADNDEGHGNNQLRLVLLLQYLENLEKLMYNAYEGCANALTSPPKVIRTFFYTNRQTCQDWLTRIRLSIMRVGLLAGQPAVTVRHGFDLLTEMKTTSLSQGNELEVTIMMVVEALCELHCPEAIQGIAVWSSSIVGKNLLWINSVAQQAEGRFEKASVEYQEHLCAMTGVDCCISSFDKSVLTLANAGRNSASPKHSLNGESRKTVLSKPTDSSPEVINYLGNKACEFYISIADWAAVQEWQNAIHDLKKSTSSTSLNLKADFNYIKSLSSFESGKFVECTEQLELLPGENINLLAGGSKEKIDMKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQMLVAELRRVTVLWDELWLGVLLQQHMYVLRRIQQLEDEVKRVQNNNTLRKEEKIAIMREKHTALMKPIVFALEHVRSITAAPAETPHEKWFQDNYGDAIENALEKLKTPLNPAKPGSSWIPFKEIMLSLQQRAQKRASYILRLEEISPWLAAMTNTEIALPGEVSARDTVTIHSVGGTITILPTKTKPKKLLFLGSDGKSYPYLFKGLEDLHLDERIMQFLSIVNTMFATINRQETPRFHARHYSVTPLGTRSGLIQWVDGATPLFGLYKRWQQREAALQAQKAQDSYQTPQNPGIVPRPSELYYSKIGPALKTVGLSLDVSRRDWPLHVMKAVLEELMEATPPNLLAKELWSSCTTPDEWWRVTQSYARSTAVMSMVGYIIGLGDRHLDNVLIDMTTGEVVHIDYNVCFEKGKSLRVPEKVPFRMTQNIETALGVTGVEGVFRLSCEQVLHIMRRGRETLLTLLEAFVYDPLVDWTAGGEAGFAGAVYGGGGQQAESKQSKREMEREITRSLFSSRVAEIKVNWFKNRDEMLVVLPKLDGSLDEYLSLQEQLTDVEKLQGKLLEEIEFLEGAEGVDHPSHTLQHRYSEHTQLQTQQRAVQEAIQVKLNEFEQWITHYQAAFNNLEATQLASLLQEISTQMDLGPPSYVPATAFLQNAGQAHLISQCEQLEGEVGALLQQRRSVLRGCLEQLHHYATVALQYPKAIFQKHRIEQWKTWMEELICNTTVERCQELYRKYEMQYAPQPPPTVCQFITATEMTLQRYAADINSRLIRQVERLKQEAVTVPVCEDQLKEIERCIKVFLHENGEEGSLSLASVIISALCTLTRRNLMMEGAASSAGEQLVDLTSRDGAWFLEELCSMSGNVTCLVQLLKQCHLVPQDLDIPNPMEASETVHLANGVYTSLQELNSNFRQIIFPEALRCLMKGEYTLESMLHELDGLIEQTTDGVPLQTLVESLQAYLRNAAMGLEEETHAHYIDVARLLHAQYGELIQPRNGSVDETPKMSAGQMLLVAFDGMFAQVETAFSLLVEKLNKMEIPIAWRKIDIIREARSTQVNFFDDDNHRQVLEEIFFLKRLQTIKEFFRLCGTFSKTLSGSSSLEDQNTVNGPVQIVNVKTLFRNSCFSEDQMAKPIKAFTADFVRQLLIGLPNQALGLTLCSFISALGVDIIAQVEAKDFGAESKVSVDDLCKKAVEHNIQIGKFSQLVMNRATVLASSYDTAWKKHDLVRRLETSISSCKTSLQRVQLHIAMFQWQHEDLLINRPQAMSVTPPPRSAILTSMKKKLHTLSQIETSIATVQEKLAALESSIEQRLKWAGGANPALAPVLQDFEATIAERRNLVLKESQRASQVTFLCSNIIHFESLRTRTAEALNLDAALFELIKRCQQMCSFASQFNSSVSELELRLLQRVDTGLEHPIGSSEWLLSAHKQLTQDMSTQRAIQTEKEQQIETVCETIQNLVDNIKTVLTGHNRQLGDVKHLLKAMAKDEEAALADGEDVPYENSVRQFLGEYKSWQDNIQTVLFTLVQAMGQVRSQEHVEMLQEITPTLKELKTQSQSIYNNLVSFASPLVTDATNECSSPTSSATYQPSFAAAVRSNTGQKTQPDVMSQNARKLIQKNLATSADTPPSTVPGTGKSVACSPKKAVRDPKTGKAVQERNSYAVSVWKRVKAKLEGRDVDPNRRMSVAEQVDYVIKEATNLDNLAQLYEGWTAWV

SEQ ID NO: 1240 - protein, 593 aa, Homo sapiens
MPRTLSLHEITDLLETDDSIEASAIVIQPPENATAPVSDEESGDEEGGTINNLPGSLLHTAAYLIQDGSDAESDSDDPSYAPKDDSPDEVPSTFTVQQPPPSRRRKMTKILCKWKKADLTVQPVAGRVTAPPNDFFTVMRTPTEILELFLDDEVIELIVKYSNLYACSKGVHLGLTSSEFKCFLGIIFLSGYVSVPRRRMFWEQRTDVHNVLVSAAMRRDRFETIFSNLHVADNANLDPVDKFSKLRPLISKLNERCMKFVPNETYFSFDEFMVPYFGRHGCKQFIRGKPIRFGYKFWCGATCLGYICWFQPYQGKNPNTKHEEYGVGASLVLQFSEALTEAHPGQYHFVFNNFFTSIALLDKLSSMGHQATGTVRKDHIDKVPLESDVALKKKERGTFDYRIDGKGNIVCRWNDNSVVTVASSGAGIHPLCLVSRYSQKLKKKIQVQQPNMIKVYNQFMGGVDRADENIDKYRASIRGKKWYSSPLLFCFELVLQNAWQLHKTYDEKPVDFLEFRRRVVCHYLETHGHPPEPGQKGRPQKRNIDSRYDGINHVIVKQGKQTRCAECHKNTTFRCEKCDVALHVKCSVEYHTE

SEQ ID NO: 1241 - protein, 882 aa, Homo sapiens
MPGRARTRARGRARRRESYQQEAPGGPRAPGSATTQEPPQLQSTPRPLQEEVPVVRPLQPRAARGGAGGGAQSQGVKEPGPEAGLHTAPLQERRIGGVFQDLVVNTRQDMKHVKDSKTGSEGTVVQLLANHFRVISRPQWVAYKYNVDYKPDIEDGNLRTILLDQHRRKFGERHIFDGNSLLLSRPLKERRVEWLSTTKDKNIVKITVEFSKELTPTSPDCLRYYNILFRRTFKLLDFEQVGRNYYTKKKAIQLYRHGTSLEIWLGYVTSVLQYENSITLCADVSHKLLRIETAYDFIKRTSAQAQTGNIREEVTNKLIGSIVLTKYNNKTYRVDDIDWKQNPEDTFNKSDGSKITYIDYYRQQHKEIVTVKKQPLLVSQGRWKKGLTGTQREPILLIPQLCHMTGLTDEICKDYSIMKELAKHTRLSPRRRHHTLKEFINTLQDNKKVRELLQLWDLKFDTNFLSVPGRVLKNANIVQGRRMVKANSQGDWSREIRELPLLNAMPLHSWLILYSRSSHREAMSLKGHLQSVTAPMGITMKPAEMIEVDGDANSYIDTLRKYTRPTLQMGMSCLLVFKVICILPNDDKRRYDSIKRYLCTKCPIPSQCVVKKTLEKVQARTIVTKIAQQMNCKMGGALWKVETDVQRTMFVGIDCFHDIVNRQKSIAGFVASTNAELTKWYSQCVIQKTGEELVKELEICLKAALDVWCKNESSMPHSVIVYRDGVGDGQLQALLDHEAKKMSTYLKTISPNNFTLAFIVVKKRINTRFFLKHGSNFQNPPPGTVIDVELTRNEWYDFFIVSQSVQDGTVTPTHYNVIYDTIGLSPDTVQRLTYCLCHMYYNLPGIIRVPAPCHYAHKLAYLVGQSIHQEPNRSLSTRLFYL

SEQ ID NO: 1242 - protein, 435 aa, Homo sapiens
MATQTLSIDSYQDGQQMQVVTELKTEQDPNCSEPDAEGVSPPPVESQTPMDVDKQAIYRHPLFPLLALLFEKCEQSTQGSEGTTSASFDVDIENFVRKQEKEGKPFFCEDPETDNLMVKAIQVLRIHLLELEKVNELCKDFCSRYIACLKTKMNSETLLSGEPGSPYSPVQSQQIQSAITGTISPQGIVVPASALQQGNVAMATVAGGTVYQPVTVVTPQGQVVTQTLSPGTIRIQNSQLQLQLNQDLSILHQDDGSSKNKRGVLPKHATNVMRSWLFQHIGHPYPTEDEKKQIAAQTNLTLLQVNNWFINARRRILQPMLDSSCSETPKTKKKTAQNRPVQRFWPDSIASGVAQPPPSELTMSEGAVVTITTPVNMNVDSLQSLSSDGATLAVQQVMMAGQSEDESVDSTEEDAGALAPAHISGLVLENSDSLQ

SEQ ID NO: 1243 - protein, 351 aa, Homo sapiens
MQRALPGARQHLGAILASASVVVKALCAAVLFLYLLSFAVDTGCLAVTPGYLFPPNFWIWTLATHGLMEQHVWDVAISLTTVVVAGRLLEPLWGALELLIFFSVVNVSVGLLGAFAYLLTYMASFNLVYLFTVRIHGALGFLGGVLVALKQTMGDCVVLRVPQVRVSVMPMLLLALLLLLRLATLLQSPALASYGFGLLSSWVYLRFYQRHSRGRGDMADHFAFATFFPEILQPVVGLLANLVHSLLVKVKICQKTVKRYDVGAPSSITISLPGTDPQDAERRRQLALKALNERLKRVEDQSIWPSMDDDEEESGAKVDSPLPSDKAPTPPGKGAAPESSLITFEAAPPTL

SEQ ID NO: 1244 - protein, 881 aa, Homo sapiens
MAAPGAPAEYGYIRTVLGQQILGQLDSSSLALPSEAKLKLAGSSGRGGQTVKSLRIQEQVQQTLARKGRSSVGNGNLHRTSSVPEYVYNLHLVENDFVGGRSPVPKTYDMLKAGTTATYEGRWGRGTAQYSSQKSVEERSLRHPLRRLEISPDSSPERAHYTHSDYQYSQRSQAGHTLHHQESRRAALLVPPRYARSEIVGVSRAGTTSRQRHFDTYHRQYQHGSVSDTVFDSIPANPALLTYPRPGTSRSMGNLLEKENYLTAGLTVGQVRPLVPLQPVTQNRASRSSWHQSSFHSTRTLREAGPSVAVDSSGRRAHLTVGQAAAGGSGNLLTERSTFTDSQLGNADMEMTLERAVSMLEADHMPPSRISAAATFIQHECFQKSEARKRVNQLRGILKLLQLLKVQNEDVQRAVCGALRNLVFEDNDNKLEVAELNGVPRLLQVLKQTRDLETKKQITDHTVNLRSRNGWPGAVAHACNPSTLGGQGGRITRSGVRDQPDQHGLLWNLSSNDKLKNLMITEALLTLTENIIIPFSGWPEGDYPKANGLLDFDIFYNVTGCLRNMSSAGADGRKAMRRCDGLIDSLVHYVRGTIADYQPDDKATENCVCILHNLSYQLEAELPEKYSQNIYIQNRNIQTDNNKSIGCFGSRSRKVKEQYQDVPMPEEKSNPKGVEWLWHSIVIRMYLSLIAKSVRNYTQEASLGALQNLTAGSGPMPTSVAQTVVQKESGLQHTRKMLHVGDPSVKKTAISLLRNLSRNLSLQNEIAKETLPDLVSIIPDTVPSTDLLIETTASACYTLNNIIQNSYQNARDLLNTGGIQKIMAISAGDAYASNKASKAASVLLYSLWAHTELHHAYKKAQFKKTDFVNSRTAKAYHSLKD

SEQ ID NO: 1245 - protein, 4684 aa, Homo sapiens
MVAGMLMPRDQLRAIYEVLFREGVMVAKKDRRPRSLHPHVPGVTNLQVMRAMASLRARGLVRETFAWCHFYWYLTNEGIAHLRQYLHLPPEIVPASLQRVRRPVAMVMPARRTPHVQAVQGPLGSPPKRGPLPTEEQRVYRRKELEEVSPETPVVPATTQRTLARPGPEPAPATDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 1246 - protein, 4684 aa, Homo sapiens [sequence omitted]

SEQ ID NO: 1247 - protein, 2135 aa, Homo sapiens
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGGPSPSPPTAPKALATPAPDTLPVEPGAPSTATASDISPGASPSLLSPWGPWAGSGSISSPGSTGSPLHEEPSPPSPQNGPGTAVPAPTDFRPSATPEDLLASPLSPSEVAAVPPADPGPEALHPTVPLDLPPATVPATTFPGAMGSVKPALDWLTREGGELPEADEWTGGDAPAFSTSTLLSGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 1248 - protein, 514 aa, Homo sapiens
MVEEVQKHSVHTLVFRSLKRTHDMFVADNGKPVPLDEESHKRKMAIKLRNEYGPVLHMPTSKENLKEKGPQNATDSYVHKQYPANQGQEVEYFVAGTHPYPPGPGVALTADTKIQRMPSESAAQSLAVALPLQTKADANRTAPSGSEYRHPGASDRPQPTAMNSIVMETGNTKNSALMAKKAPTMPKPQWHPPWKLYRVISGHLGWVRCIAVEPGNQWFVTGSADRTIKIWDLASGKLKLSLTGHISTVRGVIVSTRSPYLFSCGEDKQVKCWDLEYNKVIRHYHGHLSAVYGLDLHPTIDVLVTCSRDSTARIWDVRTKASVHTLSGHTNAVATVRCQAAEPQIITGSHDTTIRLWDLVAGKTRVTLTNHKKSVRAVVLHPRHYTFASGSPDNIKQWKFPDGSFIQNLSGHNAIINTLTVNSDGVLVSGADNGTMHLWDWRTGYNFQRVHAAVQPGSLDSESGIFACAFDQSESRLLTAEADKTIKVYREDDTATEETHPVSWKPEIIKRKRF

SEQ ID NO: 1249 - protein, 360 aa, Homo sapiens
MNYTESSPLRESTAIGFTPELESIIPVPSNKTTCENWREIHHLVFHVANICFAVGLVIPTTLHLHMIFLRGMLTLGCTLYIVWATLYRCALDIMIWNSVFLGVNILHLSYLLYKKRPVKIEKELSGMYRRLFEPLRVPPDLFRRLTGQFCMIQTLKKGQTYAAEDKTSVDDRLSILLKGKMKVSYRGHFLHNIYPCAFIDSPEFRSTQMHKGEKFQVTIIADDNCRFLCWSRERLTYFLESEPFLYEIFRYLIGKDITNKLYSLNDPTLNDKKAKKLEHQLSLCTQISMLEMRNSIASSSDSDDGLHQFLRGTSSMSSLHVSSPHQRASAKMKPIEEGAEDDDDVFEPASPNTLKVHQLP

SEQ ID NO: 1250 - protein, 756 aa, Homo sapiens
MSRPGTATPALALVLLAVTLAGVGAQGAALEDPDYYGQEIWSREPYYARPEPELETFSPPLPAGPGEEWERRPQEPRPPKRATKPKKAPKREKSAPEPPPPGKHSNKKVMRTKSSEKAANDDHSVRVAREDVRESCPPLGLETLKITDFQLHASTVKRYGLGAHRGRLNIQAGINENDFYDGAWCAGRNDLQQWIEVDARRLTRFTGVITQGRNSLWLSDWVTSYKVMVSNDSHTWVTVKNGSGDMIFEGNSEKEIPVLNELPVPMVARYIRINPQSWFDNGSICMRMEILGCPLPDPNNYYHRRNEMTTTDDLDFKHHNYKEMRQLMKVVNEMCPNITRIYNIGKSHQGLKLYAVEISDHPGEHEVGEPEFHYIAGAHGNEVLGRELLLLLVQFVCQEYLARNARIVHLVEETRIHVLPSLNPDGYEKAYEGGSELGGWSLGRWTHDGIDINNNFPDLNTLLWEAEDRQNVPRKVPNHYIAIPEWFLSENATVAAETRAVIAWMEKIPFVLGGNLQGGELVVAYPYDLVRSPWKTQEHTPTPDDHVFRWLAYSYASTHRLMTDARRRVCHTEDFQKEEGTVNGASWHTVAGSLNDFSYLHTNCFELSIYVGCDKYPHESQLPEEWENNRESLIVFMEQVHRGIKGLVRDSHGKGIPNAIISVEGINHDIRTANDGDYWRLLNPGEYVVTAKAEGFTASTKNCMVGYDMGATRCDFTLSKTNMARIREIMEKFGKQPVSLPARRLKLRGRKRRQRG

SEQ ID NO: 1251 - protein, 314 aa, Homo sapiens
MHPAGLAAAAAGTPRLRKWPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMIRTLRLKILADAAAEGVPVRGARNQLRMYLTMAVAAAQPMLMYWLTFHLVR

SEQ ID NO: 1252 - protein, 509 aa, Homo sapiens
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 1253 - protein, 684 aa, Homo sapiens; identical to SEQ ID NO: 826

SEQ ID NO: 1254 - protein, 333 aa, Homo sapiens
MNTTVMQGFNRSERCPRDTRIVQLVFPALYTVVFLTGILLNTLALWVFVHIPSSSTFIIYLKNTLVADLIMTLMLPFKILSDSHLAPWQLRAFVCRFSSVIFYETMYVGIVLLGLIAFDRFLKIIRPLRNIFLKKPVFAKTVSIFIWFFLFFISLPNMILSNKEATPSSVKKCASLKGPLGLKWHQMVNNICQFIFWTVFILMLVFYVVIAKKVYDSYRKSKSKDRKNNKKLEGKVFVVVAVFFVCFAPFHFARVPYTHSQTNNKTDCRLQNQLFIAKETTLFLAATNICMDPLIYIFLCKKFTEKLPCMQGRKTTASSQENHSSQTDNITLG

SEQ ID NO: 1255 - protein, 795 aa, Homo sapiens
MSKRHRLDLGEDYPSGKKRAGTDGKDRDRDRDREDRSKDRDRERDRGDREREREKEKEKELRASTNAMLISAGLPPLKASHSAHSTHSAHSTHSTHSAHSTHAGHAGHTSLPQCINPFTNLPHTPRYYDILKKRLQLPVWEYKDRFTDILVRHQSFVLVGETGSGKTTQIPQWCVEYMRSLPGPKRGVACTQPRRVAAMSVAQRVADEMDVMLGQEVGYSIRFEDCSSAKTILKYMTDGMLLREAMNDPLLERYGVIILDEAHERTLATDILMGVLKEVVRQRSDLKVIVMSATLDAGKFQIYFDNCPLLTIPGRTHPVEIFYTPEPERDYLEAAIRTVIQIHMCEEEEGDLLLFLTGQEEIDEACKRIKREVDDLGPEVGDIKIIPLYSTLPPQQQQRIFEPPPPKKQNGAIGRKVVVSTNIAETSLTIDGVVFVIDPGFAKQKVYNPRIRVESLLVTAISKASAQQRAGRAGRTRPGKCFRLYTEKAYKTEMQDNTYPEILRSNLGSVVLQLKKLGIDDLVHFDFMDPPAPETLMRALELLNYLAALNDDGDLTELGSMMAEFPLDPQLAKMVIASCDYNCSNEVLSITAMLSVPQCFVRPTEAKKAADEAKMRFAHIDGDHLTLLNVYHAFKQNHESVQWCYDNFINYRSLMSADNVRQQLSRIMDRFNLPRRSTDFTSRDYYINIRKALVTGYFMQVAHLERTGHYLTVKDNQVVQLHPSTVLDHKPEWVLYNEFVLTTKNYIRTCTDIKPEWLVKIAPQYYDMSNFPQCEAKRQLDRIIAKLQSKEYSQY

SEQ ID NO: 1256 - protein, 430 aa, Homo sapiens
MALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKKHTNAEKKLADRESALASADLEEEIHQKQGQKRKNSQPGVKVADRKILDDTEDTVVSQRKKIQINQEEERLKNERTVFVGNLPVTCNKKKLKSFFKEYGQIESVRFRSLIPAEGTLSKKLAAIKRKIHPDQKNINAYVVFKEESAATQALKRNGAQIADGFRIRVDLASETSSRDKRSVFVGNLPYKVEESAIEKHFLDCGSIMAVRIVRDKMTGIGKGFGYVLFENTDSVHLALKLNNSELMGRKLRVMRSVNKEKFKQQNSNPRLKNVSKPKQGLNFTSKTAEGHPKSLFIGEKAVLLKTKKKGQKKSGRPKKQRKQK

SEQ ID NO: 1257 - protein, 534 aa, Homo sapiens
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLRRATISNPITGDLETVHYRISKSAWLSGYENPVVSRINMRIQDLTGLDVSTAEELQVANYGVGGQYEPHFDFARKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 1258 - protein, 139 aa, Homo sapiens [sequence omitted]

SEQ ID NO: 1259 - protein, 124 aa, Homo sapiens
ADEELEALRRQRLAELQAKHGDPGDAAQQEAKHREAEMRNSILAQVLDQSARARLSNLALVKPEKTKAVENYLIQMARYGQLSEKVSEQGLIEILKKVSQQTEKTTTVKFNRRKVMDSDEDDDY

SEQ ID NO: 1260 - protein, 539 aa, Homo sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPASVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 1261 - protein, 953 aa, Homo sapiens
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 1262 - protein, 534 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLLRNYLHYSLYDQAEKLVSKSVFPEQANNNEWARYLYYTGRIKAIQLEYSEARRTMTNALRKAPQHTAVGFKQTVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKAIRDGVIEASINHEKGYVQSKEMIDIYSTREPQLAFHQRISFCLDIHNMSVKAMRFPPKSYNKDLESAEERREREQQDLEFAKEMAEDDDDSFP

SEQ ID NO: 1263 - protein, 254 aa, Homo sapiens
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 1264 - protein, 244 aa, Homo sapiens
MFRRKLTALDYHNPAGFNCKDETEFRNFIVWLEDQKIRHYKIEDRGNLRNIHSSDWPKFFEKYLRDVNCPFKIQDRQEAIDWLLGLAVRLEYGDNAEKYKDLVPDNSKTADNATKNAEPLINLDVNNPDFKAGVMALANLLQIQRHDDYLVMLKAIRILVQERLTQDAVAKANQTKEGLPVALDKHILGFDTGDAVLNEAAQILRLLHIEELRELQTKINEAIVAVQAIIADPKTDHRLGKVGR

SEQ ID NO: 1265 - protein, 1494 aa, Homo sapiens
MYSEWRSLHLVIQNDQGHTSVLHSYPESVGREVANAVVRPLGQVLGTPSVAGSENLLKTDKEVKWTMEVICYGLTLPLDGETVKYCVDVYTDWIMALVLPKDSIPLPVIKEPNQYVQTILKHLQNLFVPRQEQGSSQIRLCLQVLRAIQKLARESSLMARETWEVLLLFLLQINDILLAPPTVQGGIAENLAEKLIGVLFEVWLLACTRCFPTPPYWKTAKEMVANWRHHPAVVEQWSKVICALTSRLLRFTYGPSFPAFKVPDEDASLIPPEMDNECVAQTWFRFLHMLSNPVDLSNPAIISSTPKFQEQFLNVSGMPQELNQYPCLKHLPQIFFRAMRGISCLVDAFLGISRPRSDSAPPTPVNRLSMPQSAAVSTTPPHNRRHRAVTVNKATMKTSTVSTAHASKVQHQTSSTSPLSSPNQTSSEPRPLPAPRRPKVNSILNLFGSWLFDAAFVHCKLHNGINRDSSMTAITTQASMEFRRKGSQMSTDTMVSNPMFDASEFPDNYEAGRAEACGTLCRIFCSKKTGEEILPAYLSRFYMLLIQGLQINDYVCHPVLASVILNSPPLFCCDLKGIDVVVPYFISALETILPDRELSKFKSYVNPTELRRSSINILLSLLPLPHHFGTVKSEVVLEGKFSNDDSSSYDKPITFLSLKLRLVNILIGALQTETDPNNTQMILGAMLNIVQDSALLEAIGCQMEMGGGENNLKSHSRTNSGISSASGGSTEPTTPDSERPAQALLRDYALNTDSAAGLLIRSIHLVTQRLNSQWRQDMSISLAALELLSGLAKVKVMVDSGDRKRAISSVCTYIVYQCSRPAPLHSRDLHSMIVAAFQCLCVWLTEHPDMLDEKDCLKEVLEIVELGISGSKSKNNEQEVKYKGDKEPNPASMRVKDAAEATLTCIMQLLGAFPSPSGPASPCSLVNETTLIKYSRLPTINKHSFRYFVLDNSVILAMLEQPLGNEQNDFFPSVTVLVRGMSGRLAWAQQLCLLPRGAKANQKLFVPEPRPVPKNDVGFKYSVKHRPFPEEVDKIPFVKADLSIPDLHEIVTEELEERHEKLRSGMAQQIAYEIHLEQQSEEELQKRSFPDPVTDCKPPPPAQEFQTARLFLSHFGFLSLEALKEPANSRLPPHLIALDSTIPGFFDDIGYLDLLPCRPFDTVFIFYMKPGQKTNQEILKNVESSRTVQPHFLEFLLSLGWSVDVGRHPGWTGHVSTSWSINCCDDGEGSQQEVISSEDIGASIFNGQKKVLYYADALTEIAFVVPSPVESLTDSLESNISDQDSDSNMDLMPGILKQPSLTLELFPNHTDNLNSSQRLSPSSRMRKLPQGRPVPPLGPETRVSVVWVERYDDIENFPLSELMTEISTGVETTANSSTSLRSTTLEKEVPVIFIHPLNTGLFRIKIQGATGKFNMVIPLVDGMIVSRRALGFLVRQTVINICRRKRLESDSYSPPHVRRKQKITDIVNKYRNKQLEPEFYTSLFQEVGLKNCSS

SEQ ID NO: 1266 - protein, 1083 aa, Homo sapiens
MSQTQDYECRSHNVDLPESRIPGSNTRLEWVEIIEPRTRERMYANLVTGECVWDPPAGVRIKRTSENQWWELFDPNTSRFYYYNASTQRTVWHRPQGCDIIPLAKLQTLKQNTESPRASAESSPGRGSSVSREGSTSSSLEPEPDTEKAQELPARAGRPAAFGTVKEDSGSSSPPGVFLEKDYEIYRDYSADGQLLHYRTSSLRWNSGAKERMLIKVADREPSFLAAQGNGYAPDGPPGVRSRRPSGSQHSPSLQTFAPEADGTIFFPERRPSPFLKRAELPGSSSPLLAQPRKPSGDSQPSSPRYGYEPPLYEEPPVEYQAPIYDEPPMDVQFEAGGGYQAGSPQRSPGRKPRPFLQPNKQGPPSPCQQLVLTKQKCPERFLSLEYSPAGKEYVRQLVYVEQAGSSPKLRAGPRHKYAPNPGGGSYSLQPSPCLLRDQRLGVKSGDYSTMEGPELRHSQPPTPLPQAQEDAMSWSSQQDTLSSTGYSPGTRKRKSRKPSLCQATSATPTEGPGDLLVEQPLAEEQPPCGTSLAPVKRAEGEAEGARGAAEPFLAQARLAWEAQQAHFHMKQRSSWDSQQDGSGYESDGALPLPMPGPVVRAFSEDEALAQQENRHWRRGTFEKLGFPQILLEKSVSVQTNLASPEPYLHPSQSEDLAACAQFESSRQSRSGVPSSSCVFPTFTLRKPSSETDIENWASKHFNKHTQGLFRRKVSIANMLAWSSESIKKPMIVTSDRHVKKEACELFKLIQMYMGDRRAKADPLHVALEVATKGWSVQGLRDELYIQLCRQTTENFRLESLARGWELMAICLAFFPPTPKFHSYLEGYIYRHMDPVNDTKGVAISTYAKYCYHKLQKAALTGAKKGLKKPNVEEIRHAKNAVFSPSMFGSALQEVMGMQRERYPERQLPWVQTRLSEEVLALNGDQTEGIFRVPGDIDEVNALKLQVDQWKVPTGLEDPHVPASLLKLWYRELEEPLIPHEFYEQCIAHYDSPEAAVAVVHALPRINRMVLCYLIRFLQVFVQPANVAVTKMDVSNLAMVMAPNCLRCQSDDPRVIFENTRKEMSFLRVLIQHLDTSFMEGVL

SEQ ID NO: 1267 - protein, 256 aa, Homo sapiens
MFQTGGLIVFYGLLAQTMAQFGGLPVPLDQTLPLNVNPALPLSPTGLAGSLTNALSNGLLSGGLLGILENLPLLDILKPGGGTSGGLLGGLLGKVTSVIPGLNNIIDIKVTDPQLLELGLVQSPDGHRLYVTIPLGIKLQVNTPLVGASLLRLAVKLDITAEILAVRDKQERIHLVLGDCTHSPGSLQISLLDGLGPLPIQGLLDSLTGILNKVLPELVQGNVCPLVNEVLRGLDITLVHDIVNMLIHGLQFVIKV

SEQ ID NO: 1268 - protein, 767 aa, Homo sapiens
MATYLEFIQQNEERDGVRFSWNVWPSSRLEATRMVVPLACLLTPLKERPDLPPVQYEPVLCSRPTCKAVLNPLCQVDYRAKLWACNFCFQRNQFPPAYGGISEVNQPAELMPQFSTIEYVIQRGAQSPLIFLYVVDTCLEEDDLQALKESLQMSLSLLPPDALVGLITFGRMVQVHELSCEGISKSYVFRGTKDLTAKQIQDMLGLTKPAMPMQQARPAQPQEHPFASSRFLQPVHKIDMNLTDLLGELQRDPWPVTQGKRPLRSTGVALSIAVGLLEGTFPNTGARIMLFTGGPPTQGPGMVVGDELKIPIRSWHDIEKDNARFMKKATKHYEMLANRTAANGHCIDIYACALDQTGLLEMKCCANLTGGYMVMGDSFNTSLFKQTFQRIFTKDFNGDFRMAFGATLDVKTSRELKIAGAIGPCVSLNVKGPCVSENELGVGGTSQWKICGLDPTSTLGIYFEVVNQHNTPIPQGGRGAIQFVTHYQHSSTQRRIRVTTIARNWADVQSQLRHIEAAFDQEAAAVLMARLGVFRAESEEGPDVLRWLDRQLIRLCQKFGQYNKEDPTSFRLSDSFSLYPQFMFHLRRSPFLQVFNNSPDESSYYRHHFARQDLTQSLIMIQPILYSYSFHGPPEPVLLDSSSILADRILLMDTFFQIVIYLGETIAQWRKAGYQDMPEYENFKHLLQAPLDDAQEILQARFPMPRYINTEHGGSQARFLLSKVNPSQTHNNLYAWGQETGAPILTDDVSLQVFMDHLKKLAVSSAC

SEQ ID NO: 1269 - protein, 1257 aa, Homo sapiens [sequence omitted]

SEQ ID NO: 1270 - protein, 932 aa, Homo sapiens
MIPARLHRDYKGLVLLGILLGTLWETGCTQIRYSVPEELEKGSRVGDISRDLGLEPRELAERGVRIIPRGRTQLFALNPRSGSLVTAGRIDREELCMGAIKCQLNLDILMEDKVKIYGVEVEVRDINDNAPYFRESELEIKISENAATEMRFPLPHAWDPDIGKNSLQSYELSPNTHFSLIVQNGADGSKYPELVLKRALDREEKAAHHLVLTASDGGDPVRTGTARIRVMVLDANDNAPAFAQPEYRASVPENLALGTQLLVVNATDPDEGVNAEVRYSFRYVDDKAAQVFKLDCNSGTISTIGELDHEESGFYQMEVQAMDNAGYSARAKVLITVLDVNDNAPEVVLTSLASSVPENSPRGTLIALLNVNDQDSEENGQVICFIQGNLPFKLEKSYGNYYSLVTDIVLDREQVPSYNITVTATDRGTPPLSTETHISLNVADTNDNPPVFPQASYSAYIPENNPRGVSLVSVTAHDPDCEENAQITYSLAENTIQGASLSSYVSINSDTGVLYALSSFDYEQFRDLQVKVMARDNGHPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADSIPQVLADLGSLESPANSETSDLTLYLVVAVAAVSCVFLAFVILLLALRLRRWHKSRLLQASGGGLTGAPASHFVGVDGVQAFLQTYSHEVSLTTDSRKSHLIFPQPNYADMLVSQESFEKSEPLLLSGDSVFSKDSHGLIEQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 1271 - protein, 936 aa, Homo sapiens
MAAQRNRSKESKDCSGLVLLCLFFGIPWEAGARQISYSIPEELEKGSFVGNISKDLGLAPRELAERGVRIVSRGRTQLFSLNPRSGSLITAGRIDREELCAQSARCVVSFNILVEDRVKLFGIEIEVTDINDNAPKFQAENLDVKINENVAAGMRFPLPEAIDPDVGVNSLQSYQLSPNKHFSLRVQSRANGVKYPELVLEHSLDREEEAIHHLVLTASDGGDPLRSGTVLVSVTVFDANDNAPVFTLPEYRVSVPENLPVGTQLLTVTATDRDEGANGEVTYSFRKLPDTQLLKFQLNKYTGEIKISENLDYEETGFYEIEIQAEDGGAYLATAKVLITVEDVNDNSPELTITSLFSPVTEDSPLGTVVALLNVHDLDSEQNGQVTCSILAYLPFKLEKSIDSYYRLVIHRALDREQVSSYNITVTATDGGSPPLSTEAHFMLQVADINDNPPTFSQVSYFTYIPENNARGASIFSVTALDPDSKENAQIIYSLAEDTIQGVPLSSYISINSDTGVLYALRSFDYEQFHELQMQVTASDSGDPPLSSNVSLSLFVLDQNDNAPEILYPALPTDGSTGVELAPRSAEPGYLVTKVVAVDRDSGQNAWLSYRLLKASEPGLFAVGEHTGEVRTARALLDRDALKQSLVVAVQDHGQPPLSATVTLTVAVADSIPQVLADLGSFESPANSETSDLTLYLVVAVAAVSCVFLAFVIVLLAHRLRRWHKSRLLQASGGGLTGVSGSHFVGVDGVRAFLQTYSHEVSLTADSRKSHLIFPQPNYADTLISQESCEKNDPLSLLDDSKFPIEDTPLVPQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 1272 - protein, 686 aa, Homo sapiens; identical to SEQ ID NO: 1223

SEQ ID NO: 1273 - protein, 1864 aa, Homo sapiens
RISPCSTLTSSTASPPASSPCSTLPPISTNATAKDCSYGAVTSPTSTLESRDSGIIATLTSYSENVERTKYAGESSKELGSGGNIKPWQSQKSSMDSCLYRVDENMTASTYSLNKIPERNLETVLSQSVQSIPLYLMPRPNSVAATSSAHLEDLAYLDEQRHTPLRTSLRMPRQSMGGARTQQDLRVRFAPYRPPDISLKPLLFEVPSITTESVFVGRDWVFHEIDAQLQSSNASVNQGVVIVGNIGFGKTAIISRLVALSCHGTRMRQIASDSPHASPKHVDANRELPLTQPPSAHSSITSGSCPGTPEMRRRQEEAMRRLASQVVAYHYCQADNAYTCLVPEFVHNVAALLCRSPQLTAYREQLLREPHLQSMLSLRSCVQDPMASFRRGVLEPLENLHKERKIPDEDFIILIDGLNEAEFHKPDYGDTIVSFLSKMIGKFPSWLKLIVTVRTSLQEITKLLPFHRIFLDRLEENEAIDQDLQAYILHRIHSSSEIQNNISLNGKMDNTTFGKLSSHLKTLSQGSYLYLKLTFDLIEKGYLVLKSSSYKVVPVSLSEVYLLQCNMKFPTQSSFDRVMPLLNVAVASLHPLTDEHIFQAINAGSIEGTLEWEDFQQRMENLSMFLIKRRDMTRMFVHPSFREWLIWREEGEKTKFLCDPRSGHTLLAFWFSRQEGKLNRQQTIELGHHILKAHIFKGLSKKVGVSSSILQGLWISYSTEGLSMALASLRNLYTPNIKVSRLLILGGANINYRTEVLNNAPILCVQSHLGYTEMVALLLEFGANVDASSESGLTPLGYAAAAGYLSIVVLLCKKRAKVDHLDKNGQCALVHAALRGHLEVVKFLIQCDWTMAGQQQGVFKKSHAIQQALIAAASMGYTEIVSYLLDLPEKDEEEVERAQINSFDSLWGETALTAAAGRGKLEVCRLLLEQGAAVAQPNRRGAVPLFSTVRQGHWQIVDLLLTHGADVNMADKQGRTPLMMAASEGHLGTVDFLLAQGASIALMDKEGLTALSWACLKGHLSVVRSLVDNGAATDHADKNGRTPLDLAAFYGDAEVVQFLVDHGAMIEHVDYSGMRPLDRAVGCRNTSVVVTLLKKGAKIGPATWAMATSKPDIMIILLSKLMEEGDMFYKKGKVKEAAQRYQYALKKFPREGFGEDLKTFRELKVSLLLNLSRCRRKMNDFGMAEEFATKALELKPKSYEAYYARARAKRSSRQFAAALEDLNEAIKLCPNNREIQRLLLRVEEECRQMQQPQQPPPPPQPQQQLPEEAEPEPQHEDIYSVQDIFEEEYLEQDVENVSIGLQTEARPSQGLPVIQSPPSSPPHRDSAYISSSPLGSHQVFDFRSSSSVGSPTRQTYQSTSPALSPTHQNSHYRPSPPHTSPAHQGGSYRFSPPPVGGQGKEYPSPPPSPLRRGPQYRASPPAESMSVYRSQSGSPVRYQQETSVSQLPGRPKSPLSKMAQRPYQMPQLPVAVPQQGLRLQPAKAQIVRSNQPSPAVHSSTVIPTGAYGQVAHSMASKYQSSQGDIGVSQSRLVYQGSIGGIVGDGRPVQHVQASLSAGAICQHGGLTKEDLPQRPSSAYRGGVRYSQTPQIGRSQSASYYPVCHSKLDLERSSSQLGSPDVSHLIRRPISVNPNEIKPHPPTPRPLLHSQSVGLRFSPSSNSISSTSNLTPTFRPSSSIQQMEIPLKPAYERSCDELSPVSPTQGGYPSEPTRSRTTPFMGIIDKTARTQQYPHLHQQNRTWAVSSVDTVLSPTSPGNLPQPESFSPPSSISNIAFYNKTNNAQNGHLLEDDYYSPHGMLANGSRGDLLERVSQASSYPDVKVARTLPVAQAYQDNLYRQLSRDSRQGQTSPIKPKRPFVESNV

SEQ ID NO: 1274 - protein, 338 aa, Homo sapiens
MTALSSENCSFQYQLRQTNQPLDVNYLLFLIILGKILLNILTLGMRRKNTCQNFMEYFCISLAFVDLLLLVNISIILYFRDFVLLSIRFTKYHICLFTQIISFTYGFLHYPVFLTACIDYCLNFSKTTKLSFKCQKLFYFFTVILIWISVLAYVLGDPAIYQSLKAQNAYSRHCPFYVSIQSYWLSFFMVMILFVAFITCWEEVTTLVQAIRITSYMNETILYFPFSSHSSYTVRSKKIFLSKLIVCFLSTWLPFVLLQVIIVLLKVQIPAYIEMNIPWLYFVNSFLIATVYWFNCHKLNLKDIGLPLDPFVNWKCCFIPLTIPNLEQIEKPISIMIC

SEQ ID NO: 1275 - protein, 233 aa, Homo sapiens
MAGVRSLRCSRGCAGGCECGDKGKCSDSSLLGKRLSEDSSRHQLLQKWASMWSSMSEDASVADMERAQLEEEAAAAEERPLVFLCSGCRRPLGDSLSWVASQEDTNCILLRCVSCNVSVDKEQKLSKREKENGCVLETLCCAGCSLNLGYVYRCTPKNLDYKRDLFCLSVEAIESYVLGSSEKQIVSEDKELFNLESRVEIEKSLTQMEDVLKALQMKLWEAESKLSFATCKS

SEQ ID NO: 1276 - protein, 919 aa, Homo sapiens
MKFAYRFSNLLGTVYRRGNLNFTCNGNSVISPVGNRVTVFDLKNNKSDTLPLATRYNVKCVGLSPDGRLAIIVDEGGDALLVSLVCRSVLHHFHFKGSVHSVSFSPDGRKFVVTKGNIAQMYHAPGKKREFNAFVLDKTYFGPYDETTCIDWTDDSRCFVVGSKDMSTWVFGAERWDNLIYYALGGHKDAIVACFFESNSLDLYSLSQDGVLCMWQCDTPPEGLRLKPPAGWKADLLQREEEEEEEEDQEGDRETTIRGKATPAEEEKTGKVKYSRLAKYFFNKEGDFNNLTAAAFHKKSHLLVTGFASGIFHLHELPEFNLIHSLSISDQSIASVAINSSGDWIAFGCSGLGQLLVWEWQSESYVLKQQGHFNSMVALAYSPDGQYIVTGGDDGKVKVWNTLSGFCFVTFTEHSSGVTGVTFTATGYVVVTSSMDGTVRAFDLHRYRNFRTFTSPRPTQFSCVAVDASGEIVSAGAQDSFEIFVWSMQTGRLLDVLSGHEGPISGLCFNPMKSVLASASWDKTVRLWDMFDSWRTKETLALTSDALAVTFRPDGAELAVATLNSQITFWDPENAVQTGSIEGRHDLKTGRKELDKITAKHAAKGKAFTALCYSADGHSILAGGMSKFVCIYHVREQILMKRFEISCNLSLDAMEEFLNRRKMTEFGNLALIDQDAGQEDGVAIPLPGVRKGDMSSRHFKPEIRVTSLRFSPTGRCWAATTTEGLLIYSLDTRVLFDPFELDTSVTPGRVREALRQQDFTRAILMALRLNESKLVQEALEAVPRGEIEVVTSSLPELYVEKVLEFLASSFEVSRHLEFYLLWTHKLLMLHGQKLKSRAGTLLPVIQFLQKSIQRHLDDLSKLCSWNHYNMQYALAVSKQRGTKRSLDPLGSEEEAEASEDDSLHLLGGGGRDSEEEMLA

SEQ ID NO: 1277 - protein, 228 aa, Homo sapiens
MAEDKTKPSELDQGKYDADDNVKIICLGDSAVGKSKLMERFLMDGFQPQQLSTYALTLYKHTATVDGRTILVDFWDTAGQERFQSMHASYYHKAHACIMVFDVQRKVTYRNLSTWYTELREFRPEIPCIVVANKIDDINVTQKSFNFAKKFSLPLYFVSAADGTNVVKLFNDAIRLAVSYKQNSQDFMDEIFQELENFSLEQEEEDVPDQEQSSSIETPSEEAASPHS

SEQ ID NO: 1278 - protein, 681 aa, Homo sapiens
MSKTFLRPKVSSTKVTDWVDPSFDDFLECSGVSTITATSLGVNNSSHRRKNGPSTLESSRFPARKRGNLSSLEQIYGLENSKEYLSENEPWVDKYKPETQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 1279 - protein, 1312 aa, Homo sapiens
MSRIEKMSILGVRSFGIEDKDKQIITFFSPLTILVGPNGAGKTTIIECLKYICTGDFPPGTKGNTFVHDPKVAQETDVRAQIRLQFRDVNGELIAVQRSMVCTQKSKKTEFKTLEGVITRTKHGEKVSLSSKCAEIDREMISSLGVSKAVLNNVIFCHQEDSNWPLSEGKALKQKFDEIFSATRYIKALETLRQVRQTQGQKVKEYQMELKYLKQYKEKACEIRDQITSKEAQLTSSKEIVKSYENELDPLKNRLKEIEHNLSKIMKLDNEIKALDSRKKQMEKDNSELEEKMEKVFQGTDEQLNDLYHNHQRTVREKERKLVDCHRELEKLNKESRLLNQEKSELLVEQGRLQLQADRHQEHIRARDSLIQSLATQLELDGFERGPFSERQIKNFHKLVRERQEGEAKTANQLMNDFAEKETLKQKQIDEIRDKKTGLGRIIELKSEILSKKQNELKNVKYELQQLEGSSDRILELDQELIKAERELSKAEKNSNVETLKMEVISLQNEKADLDRTLRKLDQEMEQLNHHTTTRTQMEMLTKDKADKDEQIRKIKSRHSDELTSLLGYFPNKKQLEDWLHSKSKEINQTRDRLAKLNKELASSEQNKNHINNELKRKEEQLSSYEDKLFDVCGSQDFESDLDRLKEEIEKSSKQRAMLAGATAVYSQFITQLTDENQSCCPVCQRVFQTEAELQEVISDLQSKLRLAPDKLKSTESELKKKEKRRDEMLGLVPMRQSIIDLKEKEIPELRNKLQNVNRDIQRLKNDIEEQETLLGTIMPEEESAKVCLTDVTIMERFQMELKDVERKIAQQAAKLQGIDLDRTVQQVNQEKQEKQHKLDTVSSKIELNRKLIQDQQEQIQHLKSTTNELKSEKLQISTNLQRRQQLEEQTVELSTEVQSLYREIKDAKEQVSPLETTLEKFQQEKEELINKKNTSNKIAQDKLNDIKEKVKNIHGYMKDIENYIQDGKDDYKKQKETELNKVIAQLSECEKHKEKINEDMRLMRQDIDTQKIQERWLQDNLTLRKRNEELKEVEEERKQHLKEMGQMQVLQMKSEHQKLEENIDNIKRNHNLALGRQKGYEEEIIHFKKELREPQFRDAEEKYREMMIVMRTTELVNKDLDIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEIIKSRSQQRNFQLLVITHDEDFVELLGRSEYVEKFYRIKKNIDQCSEIVKCSVSSLGFNVH

SEQ ID NO: 1280 - protein, 1047 aa, Homo sapiens
MMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGNVPELPDTTEHSRTDLSRDLAALHEICVAHSDELRTLSNERGAQQHVLKKLLAITELLQQKQNQYTKTNDVR

SEQ ID NO: 1281 - protein, 1237 aa, Homo sapiens
MQKSVRYNEGHALYLAFLARKEGTKRGFLSKKTAEASRWHEKWFALYQNVLFYFEGEQSCRPAGMYLLEGCSCERTPAPPRAGAGQGGVRDALDKQYYFTVLFGHEGQKPLELRCEEEQDGKEWMEAIHQASYADILIEREVLMQKYIHLVQIVETEKIAANQLRHQLEDQDTEIERLKSEIIALNKTKERMRPYQSNQEDEDPDIKKIKKVQSFMRGWLCRRKWKTIVQDYICSPHAESMRKRNQIVFTMVEAESEYVHQLYILVNGFLRPLRMAASSKKPPISHDDVSSIFLNSETIMFLHEIFHQGLKARIANWPTLILADLFDILLPMLNIYQEFVRNHQYSLQVLANCKQNRDFDKLLKQYEANPACEGRMLETFLTYPMFQIPRYIITLHELLAHTPHEHVERKSLEFAKSKLEELSRVMHDEVSDTENIRKNLAIERMIVEGCDILLDTSQTFIRQGSLIQVPSVERGKLSKVRLGSLSLKKEGERQCFLFTKHFLICTRSSGGKLHLLKTGGVLSLIDCTLIEEPDASDDDSKGSGQVFGHLDFKIVVEPPDAAAFTVVLLAPSRQEKAAWMSDISQCVDNIRCNGLMTIVFEENSKVTVPHMIKSDARLHKDDTDICFSKTLNSCKVPQIRYASVERLLERLTDLRFLSIDFLNTFLHTYRIFTTAAVVLGKLSDIYKRPFTSIPVRSLELFFATSQNNRGEHLVDGKSPRLCRKFSSPPPLAVSRTSSPVRARKLSLTSPLNSKIGALDLTTSSSPTTTTQSPAASPPPHTGQIPLDLSRGLSSPEQSPGTVEENVDNPRVDLCNKLKRSIQKAVLESAPADRAGVESSPAADTTELSPCRSPSTPRHLRYRQPGGQTADNAHCSVSPASAFAIATAAAGHGSPPGFNNTERTCDKEFIIRRTATNRVLNVLRHWVSKHAQDFELNNELKMNVLNLLEEVLRDPDLLPQERKAAANILRALSQDDQDDIHLKLEDIIQMTDCMKAECFESLSAMELAEQITLLDHVIFRSIPYEEFLGQGWMKLDKNERTPYIMKTSQHFNDMSNLVASQIMNYADVSSRANAIEKWVAVADICRCLHNYNGVLEITSALNRSAIYRLKKTWAKVSKQTKALMDKLQKTVSSEGRFKNLRETLKNCNPPAVPYLGMYLTDLAFIEEGTPNFTEEGLVNFSKMRMISHIIREIRQFQQTSYRIDHQPKVAQYLLDKDLIIDEDTLYELSLKIEPRLPA

SEQ ID NO: 1282 - protein, 466 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRGGLGGGMRGPPRGGMVQKPGFGVGRGLAPRQ

SEQ ID NO: 1283 - protein, 221 aa, Homo sapiens
MSDGDYDYLIKFLALGDSGVGKTSVLYQYTDGKFNSKFITTVGIDFRPKRVVYRASGPDGPVGRGQRIHLQLWDTAGQERFRSLTTAFFRDAMGFLLLFDLTNEQSFLNVRNWISQLQMHAYCENPDIVLCGNKSDLEDQRVVKEEEAIALAEKYGIPYFETSAANGTNISQAIEMLLDLIMKRMERCVDKSWIPEGVVRSNGHASTDQLSEEKEKGACGC

SEQ ID NO: 1284 - protein, 219 aa, Homo sapiens
MASAGDTQAGPRDAADQNFDYMFKLLLIGNSSVGKTSFLFRYADDSFTPAFVSTVGIDFKVKTVYRHDKRIKLQIWDTAGQERYRTITTAYYRGAMGFLLMYDIANQESFAAVQDWATQIKTYSWDNAQVILVGNKCDLEDERVVPAEDGRRLADDLGFEFFEASAKENINVKQVFERLVDVICEKMNESLEPSSSSGSNGKGPAVGDAPAPQPSSCSC

SEQ ID NO: 1285 - protein, 925 aa, Homo sapiens; identical to SEQ ID NO: 1211

SEQ ID NO: 1286 - protein, 739 aa, Homo sapiens
MYQVVQTIGSDGKNLLQLLPIPKSSGNLIPLVQSSVMSNAKGNPGNQFSYQTQISSSSTSASVQLPIFQPASSSNYFPSRPVDTSEKGRVTSVGTGNFSSSVSKVQSHGVKIDGLTMQTFAVPPSTQKDSSFIVVNTQSLPVTVKSPVLPSGHHLQIPAHAEVKSVPASSLPPSVQQKILATATTSTSGMVEASQMPTVIYVSPVNTVKNVVTKNFQNIYPKPVTEIAKPVILNTTQIPKNVATETQLKGGQHSQAAPVKWIFQDNLQPFTPSLVPVKSSNNVASKILKTFVDRKNLGDNTINMPPLSTIDPSGTRSKNMPIKDNALVMFNGKVYLLAKKGTDVLPSQIDQQNSVSPDTPVRKDTLQTVSSSPVTEISREVVNIVLAKSKSSQMETKSLSNTQLASMANLRAEKNKVEKPSPSTTNPHMNQSSNYLKQSKTLFTNPIFPVGFSTGHNAPRKVTAVIYARKGSVLQSIEKISSSVDATTVTSQQCVFRDQEPKIHNEMASTSDKGAQGRNDKKDSQGRSNKALHLKSDAEFKKIFGLTKDLRVCLTRIPDHLTSGEGFDSFSSLVKSGTYKETEFMVKEGERKQQNFDKKRKAKTNKKMDHIKKRKTENAYNAIINGEANVTGSQLLSSILPTSDVSQHNILTSHSKTRQEKRTEMEYYTHEKQEKGTLNSNAAYEQSHFFNKNYTEDIFPVTPPELEETIRDEKIRRLKQVLREKEAALEEMRKKMHQK

SEQ ID NO: 1287 - protein, 308 aa, Homo sapiens
MFNGEPGPASSGASRNVVRSSSISGEICGSQQAGGGAGTTTAKKRRSSLGAKMVAIVGLTQWSKSTLQLPQPEGATKKLRSNIRRSTETGIAVEMRSRVTRQGSRESTDGSTNSNSSDGTFIFPTTRLGAESQFSDFLDGLGPAQIVGRQTLATPPMGDVHIAIMDRSGQLEVEVIEARGLTPKPGSKSLPATYIKVYLLENGACLAKKKTKMTKKTCDPLYQQALLFDEGPQGKVLQVIVWGDYGRMDHKCFMGMAQIMLDELDLSAAVTGWYKLFPTSSVADSTLGSLTRRLSQSSLESATSPSCS

SEQ ID NO: 1288 - protein, 500 aa, Homo sapiens
MSFEELCYKNPKMAIQKISDDYKIYCEKAPKIDFKMEIIKETKTVSRSNRKMSLLKRTLVRKPSMRPRNLTEVLLNTQHLEFFREFLKERKAKIPLQFLTAVQKISIETNEKICKSLIENVIKTFFQGQLSPEEMLQCDAPIIKEIASMRHVTTSTLLTLQGHVMKSIEEKWFKDYQDLFPPHHQEVEVQSEVQISSRKPSKIVSTYLQESQKKGWMRMISFIRSFCKYRRFMLNPSKRQEFEDYLHQEMQNSKENFTTAHNTSGRSAPPSTNVRSADQENGEITLVKRRIFGHRIITVNFAINDLYFFSEMEKFNDLVSSAHMLQVNRAYNENDVILMRSKMNIIQKLFLNSDIPPKLRVNVPEFQKDAILAAITEGYLDRSVFHGAIMSVFPVVMYFWKRFCFWKATRSYLQYRGKKFKDRKSPPKSTDKYPFSSGGDNAILRFTLLRGIEWLQPQREAISSVQNSSSSKLTQPRLVVSAMQLHPVQGQKLSYIKKEK

SEQ ID NO: 1289 - protein, 979 aa, Homo sapiens
MATQAYTELQAAPPPSQPPQAPPQAQPQPPPPPPPAAPQPPQPPTAAATPQPQYVTELQSPQPQAQPPGGQKQYVTELPAVPAPSQPTGAPTPSPAPQQYIVVTVSEGAMRASETVSEASPGSTASQTGVPTQVVQQVQGTQQRLLVQTSVQAKPGHVSPLQLTNIQVPQQALPTQRLVVQSAAPGSKGGQVSLTVHGTQQVHSPPEQSPVQANSSSSKTAGAPTGTVPQQLQVHGVQQSVPVTQERSVVQATPQAPKPGPVQPLTVQGLQPVHVAQEVQQLQQVPVPHVYSSQVQYVEGGDASYTASAIRSSTYSYPETPLYTQTASTSYYEAAGTATQVSTPATSQAVASSGSMPMYVSGSQVVASSASTGAGASNSSGGGGSGGGGGGGGGGGGGGSGSTGGGGSGAGTYVIQGGYMLGSASQSYSHTTRASPATVQWLLDNYETAEGVSLPRSTLYCHYLLHCQEQKLEPVNAASFGKLIRSVFMGLRTRRLGTRGNSKYHYYGLRIKASSPLLRLMEDQQHMAMRGQPFSQKQRLKPIQKMEGMTNGVAVGQQPSTGLSDISAQVQQYQQFLDASRSLPDFTELDLQGKVLPEGVGPGDIKAFQVLYREHCEAIVDVMVNLQFTLVETLWKTFWRYNLSQPSEAPPLAVHDEAEKRLPKAILVLLSKFEPVLQWTKHCDNVLYQGLVEILIPDVLRPIPSALTQAIRNFAKSLESWLTHAMVNIPEEMLRVKVAAAGAFAQTLRRYTSLNHLAQAARAVLQNTAQINQMLSDLNRVDFANVQEQASWVCRCEDRVVQRLEQDFKVTLQQQNSLEQWAAWLDGVVSQVLKPYQGSAGFPKAAKLFLLKWSFYSSMVIRDLTLRSAASFGSFHLIRLLYDEYMYYLIEHRVAQAKGETPIAVMGEFANLATSLNPLDPDKDEEEEEEEESEDELPQDISLAAGGESPALGPETLEPPAKLARTDARGLFVQALPSS

SEQ ID NO: 1290 - protein, 928 aa, Homo sapiens
MPPKTPRKTAATAAAAAAEPPAPPPPPPPEEDPEQDSGPEDLPLVRLEFEETEEPDFTALCQKLKIPDHVRERAWLTWEKVSSVDGVLGGYIQKKKELWGICIFIAAVDLDEMSFTFTELQKNIEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 1291 - protein, 1386 aa, Homo sapiens
MLRYLLKTLLQMNLFADSLAGDISNSSELLLGFNSSLAALNHTLLPPGDPSLNGSRVGPEDAMPRIVEQPPDLLVSRGEPATLPCRAEGRPRPNIEWYKNGARVATVREDPRAHRLLLPSGALFFPRIVHGRRARPDEGVYTCVARNYLGAAASRNASLEVAVLRDDFRQSPGNVVVAVGEPAVLECVPPRGHPEPSVSWRKDGARLKEEEGRITIRGGKLMMSHTLKSDAGMYVCVASNMAGERESAAAEVMVLERPSFLRRPVNQVVLADAPVTFLCEVKGDPPPRLRWRKEDGELPTGRYEIRSDHSLWIGHVSAEDEGTYTCVAENSVGRAEASGSLSVHVPPQLVTQPQDQMAAPGESVAFQCETKGNPPPAIFWQKEGSQVLLFPSQSLQPTGRFSVSPRGQLNITAVQRGDAGYYVCQAVSVAGSILAKALLEIKGASLDGLPPVILQGPANQTLVLGSSVWLPCRVTGNPQPSVRWKKDGQWLQGDDLQFKTMANGTLYIANVQEMDMGFYSCVAKSSTGEATWSGWLKMREDWGVSPDPPTEPSSPPGAPSQPVVTEITKNSITLTWKPNPQTGAAVTSYVIEAFSPAAGNTWRTVADGVQLETHTVSGLQPNTIYLFLVRAVGAWGLSEPSPVSEPVRTQDSSPSRPVEDPWRGQQGLAEVAVRLQEPIVLGPRTLQVSWTVDGPVQLVQGFRVSWRVAGPEGGSWTMLDLQSPSQQSTVLRGLPPGTQIQIKVQAQGQEGLGAESLSVTRSIPEEAPSGPPQGVAVALGGDGNSSITVSWEPPLPSQQNGVITEYQIWCLGNESRFHLNRSAAGWARSAMLRGLVPGLLYRTLVAAATSAGVGVPSAPVLVQLPSPPDLEPGLEVGAGLAVRLARVLREPAFLAGSGAACGALLLGLCAALYWRRKQRKELSHYTASFAYTPAVSFPHSEGLSGASSRPPMGLGPAPYSWLADSWPHPSRSPSAQEPRGSCCPSNPDPDDRYYNEAGISLYLAQTARGTAAPGEGPVYSTIDPAGEELQTFHGGFPQHPSGDLGPWSQYAPPEWSQGDSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 1292 - protein, 642 aa, Homo sapiens
MKRSSVSSGGAGRLSMQELRSQDVNKQGLYTPQTKEKPTFGKLSINKPTSERKVSLFGKRTSGHGSRNSQLGIFSSSEKIKDPRPLNDKAFIQQCIRQLCEFLTENGYAHNVSMKSLQAPSVKDFLKIFTFLYGFLCPSYELPDTKFEEEVPRIFKDLGYPFALSKSSMYTVGAPHTWPHIVAALVWLIDCIKIHTAMKESSPLFDDGQPWGEETEDGIMHNKLFLDYTIKCYESFMSGADSFDEMNAELQSKLKDLFNVDAFKLESLEAKNRALNEQIARLEQEREKEPNRLESLRKLKASLQGDVQKYQAYMSNLESHSAILDQKLNGLNEEIARVELECETIKQENTRLQNIIDNQKYSVADIERINHERNELQQTINKLTKDLEAEQQKLWNEELKYARGKEAIETQLAEYHKLARKLKLIPKGAENSKGYDFEIKFNPEAGANCLVKYRAQVYVPLKELLNETEEEINKALNKKMGLEDTLEQLNAMITESKRSVRTLKEEVQKLDDLYQQKIKEAEEEDEKCASELESLEKHKHLLESTVNQGLSEAMNELDAVQREYQLVVQTTTEERRKVGNNLQRLLEMVATHVGSVEKHLEEQIAKVDREYEECMSEDLSENIKEIRDKYEKKATLIKSSEE

SEQ ID NO: 1293 - protein, 1233 aa, Homo sapiens
MSIDHLKQKIPPALFYKETYLGPNEVLKNGMYCSLYEVVEKTRIGSNMESLLQKLDREKLVLVKPLGDRGYLFLLSPYQMVPPYEYQTAKSRVLHALFLFQEPRSIVTSQKGSTNAAPQERHESMPDVLKIAQFLQFSLIQCRKEFKNISAINFHSVVEKYVSEFFKRGFGSGKREFIMFPYDSRLDDKKFLYSAPRNKSHIDTCLHAYIFRPEVYQLPICKLKELFEENRKLQQFSPLSDYEGQEEEMNGTKMKFGKRNNSRGEAIISGKQRSSHSLDYDKDRVKELINLIQCRKKSVGGDSDTEDMRSKTVLKRKLEDLPENMRKLAKTSNLSENCHLYEESPQPIGSLGHDADLRRQQQDTCNSGIADIHRLFNWLSETLANARHSDASLTDTVNKALGLSTDDAYEELRQKHEYELNSTPDKKDYEQPTCAKVENAQFKGTQSLLLEVDATSKYSVAISTSEVGTDHKLHLKEDPNLISVNNFEDCSLCPSVPIEHGFRRQQSKSNNVEETEIHWKLIPITGGNARSPEDQLGKHGEKQTPDTLKGTTEDDVLTGQVEEQCVPAAEAEPPAVSETTERTVLGEYNLFSRKIEEILKQKNVSYVSRVSTPIFSTQEKMKRLSEFIYSKTSKAGVQEFVDGLHEKLNTIIIKASAKGGNLPPVSPNDSGAKIASNPLERHVIPVSSSDFSNKHLLGPLCSDPLKDTNSDEQHSTSALTEVEMNQPQHATELMVTSDHIVPGDMAREPVEETTKSPSDVNISAQPALSNFISQLEPEVFNSLVKIMKDVQKNTVKFYIHEEEESVLCKEIKEYLIKLGNTECHPEQFLERRSKLDKLLIIIQNEDIAGFIHKIPGLVTLKKLPCVSFAGVDSLDDVKNHTYNELFVSGGFIVSDESILNPEVVTVENLKNFLTFLEELSTPEGKWQWKVHCKFQKKLKELGRLNAKALSLLTLLNVYQKKHLVEILSYHNCDSQTRNAPELDCLIRLQAQNIQQRHIVFLTEKNIKMLSSYTDNGIVVATAEDFMQNFKNLVGYHNSITEENLPQLGANENLESQSALLENDEKDEEDMSLDSGDEISHIEVCSNFHSEIWEKETKGSRGTDQKKNTQIELQSSPDVQNSLLEDKTYLDSEERTSIDIVCSEGENSNSTEQDSYSNFQVYHSQLNMSHQFSHFNVLTHQTFLGTPYALSSSQSQENENYFLSAYTESLDRDKSPPPLSWGKSDSSRPYSQEK

SEQ ID NO: 1294 - protein, 1257 aa, Homo sapiens
MKAADEPAYLTVGTDVSAKYRGAFCEAKIKTVKRLVKVKVLLKQDNTTQLVQDDQVKGPLRVGAIVETRTSDGSFQEAIISKLTDASWYTVVFDDGDERTLRRTSLCLKGERHFAESETLDQLPLTNPEHFGTPVIAKKTNRGRRSSLPVTEDEKEEESSEEEDEDKRRLNDELLGKVVSVVSATERTEWYPALVISPSCNDDITVKKDQCLVRSFIDSKFYSIARKDIKEVDILNLPESELSTKPGLQKASIFLKTRVVPDNWKMDISEILESSSSDDEDGPAEENDEEKEKEAKKTEEEVPEEELDPEERDNFLQQLYKFMEDRGTPINKPPVLGYKDLNLFKLFRLVYHQGGCDNIDSGAVWKQIYMDLGIPILNSAASYNLKTAYRKYLYGFEEYCRSANIQFRTVHHHEPKVKEEKKDLEESMEEALKLDQEMPLTEVKSEPEENIDSNSESEREEIELKSPRGRRRIARDVNSIKKEIEEEKTEDKLKDNDTENKDVDDDYETAEKKENELLLGRKNTPKQKEKKIKKQEDSDKDSDEEEEKSQEREETESKCDSEGEEDEEDMEPCLTGTKVKVKYGRGKTQKIYEASIKSTEIDDGEVLYLVHYYGWNVSYDEWVKADRIIWPLDKGGPKKKQKKKAKNKEDSEKDEKRDEERQKSKRGRPPLKSTLSSNMPYGLSKTANSEGKSDSCSSDSETEDALEKNLINEELSLKDELEKNENLNDDKLDEENPKISAHILKENDRTQMQPLETLKLEVGENEQIVQIFGNKMEKAEEVKKEAEKSPKGKGRRSKTKDLSLEIIKISSFGQNEAGSEPHIEAHSLELSSLDNKNFSSATEDEIDQCVKEKKLKRKILGQSSPEKKIRIENGMEMTNTVSQERTSDCIGSEGMKNLNFEQHFERENEGMPSLIAESNQCIQQLTSERFDSPAEETVNIPLKEDEDAMPLIGPETLVCHEVDLDDLDEKDKTSIEDVAVESSESNSLVSIPPALPPVVQHNFSVASPLTLSQDESRSVKSESDITIEVDSIAEESQEGLCERESANGFETNVASGTCSIIVQERESREKGQKRPSDGNSGLMAKKQKRTPKRTSAAAKNEKNGTGQSSDSEDLPVLDNSSKCTPVKHLNVSKPQKLARSPARISPHIKDGEKDKHREKHPNSSPRTYKWSFQLNELDNMNSTERISFLQEKLQEIRKYYMSLKSEVATIDRRRKRLKKKDREVSHAGASMSSASSDTGMSPSSSSPPQNVLAVECR

SEQ ID NO: 1295 - protein, 1722 aa, Homo sapiens
MAGVGPGGYAAEFVPPPECPVFEPSWEEFTDPLSFIGRIRPLAEKTGICKIRPPKDWQPPFACEVKSFRFTPRVQRLNELEAMTRVRLDFLDQLAKFWELQGSTLKIPVVERKILDLYALSKIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHRQSPDSGRTRTKLTVEELKAFVQQLFSLPCVISQARQVKNLLDDVEEFHERAQEAMMDETPDSSKLQMLIDMGSSLYVELPELPRLKQELQQARWLDEVRLTLSDPQQVTLDVMKKLIDSGVGLAPHHAVEKAMAELQELLTVSERWEEKAKVCLQARPRHSVASLESIVNEAKNIPAFLPNVLSLKEALQKAREWTAKVEAIQSGSNYAYLEQLESLSAKGRPIPVRLEALPQVESQVAAARAWRERTGRTFLKKNSSHTLLQVLSPRTDIGVYGSGKNRRKKVKELIEKEKEKDLDLEPLSDLEEGLEETRDTAMVVAVFKEREQKEIEAMHSLRAANLAKMTMVDRIEEVKFCICRKTASGFMLQCELCKDWFHNSCVPLPKSSSQKKGSSWQAKEVKFLCPLCMRSRRPRLETILSLLVSLQKLPVRLPEGEALQCLTERAMSWQDRARQALATDELSSALAKLSVLSQRMVEQAAREKTEKIISAELQKAAANPDLQGHLPSFQQSAFNRVVSSVSSSPRQTMDYDDEETDSDEDIRETYGYDMKDTASVKSSSSLEPNLFCDEEIPIKSEEVVTHMWTAPSFCAEHAYSSASKSCSQVFFGKGSSTPRKQPRKSPLVPRSLEPPVLELSPGAKAQLEELMMVGDLLEVSLDETQHIWRILQATHPPSEDRFLHIMEDDSMEEKPLKVKGKDSSEKKRKRKLEKVEQLFGEGKQKSKELKKMDKPRKKKLKLGADKSKKLNKLAKKLAKEEERKKKKEKAAAAKVELVKESTEKKREKKVLDIPSKYDWSGAEESDDENAVCAEPDCQRPCKDKGVVFVTKKREIKNISFKSVLCDCFSKKVDWVQCDGGCDEWFHRVCVGVSPEMAENEDYICINCAKKQGPVSPGPAPPPSFIMSYKLPMEDLKETS

SEQ ID NO: 1296 - protein, 1191 aa, Homo sapiens
MEAMSPQQETLGGQPGRSSSLTGVSRLAGGSCTKKKMKTLAERRRSAPSLILDKALQKRPTTRDSPSASVDTCTFLSSLVCSNRTLLIDGRAELKRGLQRQERHLFLFNDLFVVAKIKYNNNFKIKNKIKLTDMWTASCVDEVGEGNTNAMKSFVLGWPTVNFVATFSSPEQKDKWLSLLQRYINLEKEKDYPKSIPLKIFAKDIGNCAYSKTITVMNSDTANEVINMSLPMLGITGSERDYQLWVNSGKEEAPYPLIGHEYPYGIKMSHLRDSALLTPGSKDSTTPFNLQEPFLMEQLPREMQCQFILKPSRLAAAQQLSDSGHKTFKRRRSIINWAFWRGSSTHLDNLPSSPTSPMPGQLFGISLPNICENDNLPKPVLDMLFFLNQKGPLTKGIFRQSANVKSCRELKEKLNSGVEVHLDCESIFVIASVLKDFLRNIPGSIFSSDLYDHWVSVMDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 1297 - protein, 262 aa, Homo sapiens
ARGPKKHLKRVAAPKHWMLDKLTGVFAPRPSTGPHKLRECLPLIVFLRNRLKYALTGDEVKKICMQHFLKIDGKVRVDITYPAGFIDVISIEKTGEHFRLVYNTKGCFAVHRITVEEAKYKLCKVRKITVGTKGIPHLVTHDARTIRYPDPLIKVNDTVQIDLGTGKITSFIKFDTGNVCMVIAGANLGRVGVITNRERHPGSCDVVHVKDANGNSFATRISNIFVIGNGNKPWISLPRGKGIRLTIAEERDKRLAAKQSSG

SEQ ID NO: 1298 - protein, 35 aa, Homo sapiens
  misc_feature (12)..(12): Xaa can be any naturally occurring amino acid
LIPVKRGPSSRXEVLLLKHLLLLLWQEAIVGWEAK

SEQ ID NO: 1299 - protein, 306 aa, Homo sapiens
MSLKLQASNVTNKNDPKSINSRVFIGNLNTALVKKSDVETIFSKYGRVAGCSVHKGYAFVQYSNERHARAAVLGENGRVLAGQTLDINMAGEPKPDRPKGLKRAASAIYSGYIFDYDYYRDDFYDRLFDYRGRLSPVPVPRAVPVKRPRVTVPLVRRVKTNVPVKLFARSTAVTTSSAKIKLKSSELQAIKTELTQIKSNIDALLSRLEQIAAEQKANPDGKKKGDGGGAGGGGGGGGSGGGGSGGGGGGGSSRPPAPQENTTSEAGLPQGEARTRDDGDEEGLLTHSEEELEHSQDTDADDGALQ

SEQ ID NO: 1300 - protein, 593 aa, Homo sapiens
MTAEDSTATMSSDSAAGSSAKVPEGVAGAPNEAALLALMERTGYSMVQENGQRKYGGPPPGWEGPHPQRGCEVFVGKIPRDVYEDELVPVFEAVGRIYELRLMMDFDGKNRGYAFVMYCHKHEAKRAVRELNNYEIRPGRLLGVCCSVDNCRLFIGGIPKMKKREEILEEIAKVTEGVLDVIVYASAADKMKNRGFAFVEYESHRAAAMARRKLMPGRIQLWGHQIAVDWAEPEIDVDEDVMETVKILYVRNLMIETTEDTIKKSFGQFNPGCVERVKKIRDYAFVHFTSREDAVHAMNNLNGTELEGSCLEVTLAKPVDKEQYSRYQKAARGGGAAEAAQQPSYVYSCDPYTLAYYGYPYNALIGPNRDYFVKAGSIRGRGRGAAGNRAPGPRGSYLGGYSAGRGIYSRYHEGKGKQQEKGYELVPNLEIPTVNPVAIKPGTVAIPAIGAQYSMFPAAPAPKMIEDGKIHTVEHMISPIAVQPDPASAAAAAAAAAAAAAAVIPTVSTPPPFQGRPITPVYTVAPNVQRIPTAGIYGASYVPFAAPATATIATLQKNAAPRPPCMEDTQATYLRPSPAAAIQVPIPDVYQTY

SEQ ID NO: 1301 - protein, 559 aa, Homo sapiens
MATATIALQVNGQQGGGSEPAAAAAVVAAGDKWKPPQGTDSIKMENGQSTAAKLGLPPLTPEQQEALQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDSVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPKKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSIASETHKAIQALNGRWFAGRKVVAEVYDQERFDNSDLSA

SEQ ID NO: 1302 - protein, 615 aa, Homo sapiens
MAPPGSSTVFLLALTIIASTWALTPTHYLTKHDVERLKASLDRPFTNLESAFYSIVGLSSLGAQVPDAKISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAAMLGLMYVYWTQLNMFQTLKYLAILGSVTFLAGNRMLAQQAVKRIAAEQSSRLAKYRTLRTAH

SEQ ID NO: 1303 - protein, 4967 aa, Homo sapiens
MADGGEGEDEIQFLRTDDEVVLQCTATIHKEQQKLCLAAEGFGNRLCFLESTSNSKNVPPDLSICTFVLEQSLSVRALQEMLANTVEKSEGQVDVEKWKFMMKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDVGVRKEVDGMGTSEIKYGDSVCYIQHVDTGLWLTYQSVDVKSVRMGSIQRKAIMHHEGHMDDGISLSRSQHEESRTARVIRSTVFLFNRFIRGLDALSKKAKASTVDLPIESVSLSLQDLIGYFHPPDEHLEHEDKQNRLRALKNRQNLFQEEGMINLVLECIDRLHVYSSAAHFADVAGREAGESWKSILNSLYELLAALIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGWASTEGYSPYPGGGEEWGGNGVGDDLFSYGFDGLHLWSGCIARTVSSPNQHLLRTDDVISCCLDLSAPSISFRINGQPVQGMFENFNIDGLFFPVVSFSAGIKVRFLLGGRHGEFKFLPPPGYAPCYEAVLPKEKLKVEHSREYKQERTYTRDLLGPTVSLTQAAFTPIPVDTSQIVLPPHLERIREKLAENIHELWVMNKIELGWQYGPVRDDNKRQHPCLVEFSKLPEQERNYNLQMSLETLKTLLALGCHVGISDEHAEDKVKKMKLPKNYQLTSGYKPAPMDLSFIKLTPSQEAMVDKLAENAHNVWARDRIRQGWTYGIQQDVKNRRNPRLVPYTPLDDRTKKSNKDSLREAVRTLLGYGYNLEAPDQDHAARAEVCSGTGERFRIFRAEKTYAVKAGRWYFEFETVTAGDMRVGWSRPGCQPDQELGSDERAFAFDGFKAQRWHQGNEHYGRSWQAGDVVGCMVDMNEHTMMFTLNGEILLDDSGSELAFKDFDVGDGFIPVCSLGVAQVGRMNFGKDVSTLKYFTICGLQEGYEPFAVNTNRDITMWLSKRLPQFLQVPSNHEHIEVTRIDGTIDSSPCLKVTQKSFGSQNSNTDIMFYRLSMPIECAEVFSKTVAGGLPGAGLFGPKNDLEDYDADSDFEVLMKTAHGHLVPDRVDKDKEATKPEFNNHKDYAQEKPSRLKQRFLLRRTKPDYSTSHSARLTEDVLADDRDDYDFLMQTSTYYYSVRIFPGQEPANVWVGWITSDFHQYDTGFDLDRVRTVTVTLGDEKGKVHESIKRSNCYMVCAGESMSPGQGRNNNGLEIGCVVDAASGLLTFIANGKELSTYYQVEPSTKLFPAVFAQATSPNVFQFELGRIKNVMPLSAGLFKSEHKNPVPQCPPRLHVQFLSHVLWSRMPNQFLKVDVSRISERQGWLVQCLDPLQFMSLHIPEENRSVDILELTEQEELLKFHYHTLRLYSAVCALGNHRVAHALCSHVDEPQLLYAIENKYMPGLLRAGYYDLLIDIHLSSYATARLMMNNEYIVPMTEETKSITLFPDENKKHGLPGIGLSTSLRPRMQFSSPSFVSISNECYQYSPEFPLDILKSKTIQMLTEAVKEGSLHARDPVGGTTEFLFVPLIKLFYTLLIMGIFHNEDLKHILQLIEPSVFKEAATPEEESDTLEKELSVDDAKLQGAGEEEAKGGKRPKEGLLQMKLPEPVKLQMCLLLQYLCDCQVRHRIEAIVAFSDDFVAKLQDNQRFRYNEVMQALNMSAALTARKTKEFRSPPQEQINMLLNFKDDKSECPCPEEIRDQLLDFHEDLMTHCGIELDEDGSLDGNSDLTIRGRLLSLVEKVTYLKKKQAEKPVESDSKKSSTLQQLISETMVRWAQESVIEDPELVRAMFVLLHRQYDGIGGLVRALPKTYTINGVSVEDTINLLASLGQIRSLLSVRMGKEEEKLMIRGLGDIMNNKVFYQHPNLMRALGMHETVMEVMVNVLGGGESKEITFPKMVANCCRFLCYFCRISRQNQKAMFDHLSYLLENSSVGLASPAMRGSTPLDVAAASVMDNNELALALREPDLEKVVRYLAGCGLQSCQMLVSKGYPDIGWNPVEGERYLDFLRFAVFCNGESVEENANVVVRLLIRRPECFGPALRGEGGNGLLAAMEEAIKIAEDPSRDGPSPNSGSSKTLDTEEEEDDTIHMGNAIMTFYSALIDLLGRCAPEMHLIHAGKGEAIRIRSILRSLIPLGDLVGVISIAFQMPTIAKDGNVVEPDMSAGFCPDHKAAMVLFLDRVYGIEVQDFLLHLLEVGFLPDLRAAASLDTAALSATDMALALNRYLCTAVLPLLTRCAPLFAGTEHHASLIDSLLHTVYRLSKGCSLTKAQRDSIEVCLLSICGQLRPSMMQHLLRRLVFDVPLLNEHAKMPLKLLTNHYERCWKYYCLPGGWGNFGAASEEELHLSRKLFWGIFDALSQKKYEQELFKLALPCLSAVAGALPPDYMESNYVSMMEKQSSMDSEGNFNPQPVDTSNITIPEKLEYFINKYAEHSHDKWSMDKLANGWIYGEIYSDSSKVQPLMKPYKLLSEKEKEIYRWPIKESLKTMLARTMRTERTREGDSMALYNRTRRISQTSQVSVDAAHGYSPRAIDMSNVTLSRDLHAMAEMMAENYHNIWAKKKKMELESKGGGNHPLLVPYDTLTAKEKAKDREKAQDILKFLQINGYAVSRGFKDLELDTPSIEKRFAYSFLQQLIRYVDEAHQYILEFDGGSRGKGEHFPYEQEIKFFAKVVLPLIDQYFKNHRLYFLSAASRPLCSGGHASNKEKEMVTSLFCKLGVLVRHRISLFGNDATSIVNCLHILGQTLDARTVMKTGLESVKSALRAFLDNAAEDLEKTMENLKQGQFTHTRNQPKGVTQIINYTTVALLPMLSSLFEHIGQHQFGEDLILEDVQVSCYRILTSLYALGTSKSIYVERQRSALGECLAAFAGAFPVAFLETHLDKHNIYSIYNTKSSRERAALSLPTNVEDVCPNIPSLEKLMEEIVELAESGIRYTQMPHVMEVILPMLCSYMSRWWEHGPENNPERAEMCCTALNSEHMNTLLGNILKIIYNNLGIDEGAWMKRLAVFSQPIINKVKPQLLKTHFLPLMEKLKKKAATVVSEEDHLKAEARGDMSEAELLILDEFTTLARDLYAFYPLLIRFVDYNRAKWLKEPNPEAEELFRMVAEVFIYWSKSHNFKREEQNFVVQNEINNMSFLITDTKSKMSKAAVSDQERKKMKRKGDRYSMQTSLIVAALKRLLPIGLNICAPGDQELIALAKNRFSLKDTEDEVRDIIRSNIHLQGKLEDPAIRWQMALYKDLPNRTDDTSDPEKTVERVLDIANVLFHLEQKSKRVGRRHYCLVEHPQRSKKAVWHKLLSKQRKRAVVACFRMAPLYNLPRHRAVNLFLQGYEKSWIETEEHYFEDKLIEDLAKPGAEPPEEDEGTKRVDPLHQLILLFSRTALTEKCKLEEDFLYMAYADIMAKSCHDEEDDDGEEEVKSFEEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDVIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGVISKRDFHKAMESHKHYTQSETEFLLSCAETDENETLDYEEFVKRFHEPAKDIGFNVAVLLTNLSEHMPNDTRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERSANKEESEKERPEEQGPRMAFFSILTVRSALFALRYNILTLMRMLSLKSLKKQMKKVKKMTVKDMVTAFFSSYWSIFMTLLHFVASVFRGFFRIICSLLLGGSLVEGAKKIKVAELLANMPDPTQDEVRGDGEEGERKPLEAALPSEDLTDLKELTEESDLLSDIFGLDLKREGGQYKLIPHNPNAGLSDLMSNPVPMPEVQEKFQEQKAKEEEKEEKEETKSEPEKAEGEDGEKEEKAKEDKGKQKLRQLHTHRYGEPEVPESAFWKKIIAYQQKLLNYFARNFYNMRMLALFVAFAINFILLFYKVSTSSVVEGKELPTRSSSENAKVTSLDSSSHRIIAVHYVLEESSGYMEPTLRILAILHTVISFFCIIGYYCLKVPLVIFKREKEVARKLEFDGLYITEQPSEDDIKGQWDRLVINTQSFPNNYWDKFVKRKVMDKYGEFYGRDRISELLGMDKAALDFSDAREKKKPKKDSSLSAVLNSIDVKYQMWKLGVVFTDNSFLYLAWYMTMSVLGHYNNFFFAAHLLDIAMGFKTLRTILSSVTHNGKQLVLTVGLLAVVVYLYTVVAFNFFRKFYNKSEDGDTPDMKCDDMLTCYMFHMYVGVRAGGGIGDEIEDPAGDEYEIYRIIFDITFFFFVIVILLAIIQGLIIDAFGELRDQQEQVKEDMETKCFICGIGNDYFDTVPHGFETHTLQEHNLANYLFFLMYLINKDETEHTGQESYVWKMYQERCWEFFPAGDCFRKQYEDQLN

SEQ ID NO: 1304 - protein, 715 aa, Homo sapiens
MVQKYQSPVRVYKYPFELIMAAYERRFPTCPLIPMFVGSDTVSEFKSEDGAIHVIERRCKLDVDAPRLLKKIAGVDYVYFVQKNSLNSRERTLHIEAYNETFSNRVIINEHCCYTVHPENEDWTCFEQSASLDIKSFFGFESTVEKIAMKQYTSNIKKGKEIIEYYLRQLEEEGITFVPRWSPPSITPSSETSSSSSKKQAASMAVVIPEAALKEGLSGDALSSPSAPEPVVGTPDDKLDADHIKRYLGDLTPLQESCLIRLRQWLQETHKGKIPKDEHILRFLRARDFNIDKAREIMCQSLTWRKQHQVDYILETWTPPQVLQDYYAGGWHHHDKDGRPLYVLRLGQMDTKGLVRALGEEALLRYVLSVNEERLRRCEENTKVFGRPISSWTCLVDLEGLNMRHLWRPGVKALLRIIEVVEANYPETLGRLLILRAPRVFPVLWTLVSPFIDDNTRRKFLIYAGNDYQGPGGLLDYIDKEIIPDFLSGECMCEVPEGGLVPKSLYRTAEELENEDLKLWTETIYQSASVFKGAPHEILIQIVDASSVITWDFDVCKGDIVFNIYHSKRSPQPPKKDSLGAHSITSPGGNNVQLIDKVWQLGRDYSMVESPLICKEGESVQGSHVTRWPGFYILQWKFHSMPACAASSLPRVDDVLASLQVSSHKCKVMYYTEVIGSEDFRGSMTSLESSHSGFSQLSAATTSSSQSHSSSMISR

SEQ ID NO: 1305 - protein, 248 aa, Homo sapiens
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSGAEPQSAPDTGFWPVPAVVTAVFILLVALVMFAWYRCRCSQQRREKKFFLLEPQMKVAALRAGAQQGLSRASAELWTPDSEPTPRPLALVFKPSPLGALELLSPQPLFPYAADP

SEQ ID NO: 1306 - protein, 172 aa, Homo sapiens
MVGPAPRRRLRPLAALALVLALAPGLPTARAGQTPRPAERGPPVRLFTEEELARYGGEEEDQPIYLAVKGVVFDVTSGKEFYGRGAPYNALTGKDSTRGVAKMSLDPADLTHDTTGLTAKELEALDEVFTKVYKAKYPIVGYTARRILNEDGSPNLDFKPEDQPHFDIKDEF

SEQ ID NO: 1307 - protein, 412 aa, Homo sapiens
MPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 1308 - protein, 1073 aa, Homo sapiens
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHEILPTSTTPDYKIFGGPTSDMEVSSSSVTTMASIPEITPKVIDTWRPKLTSSRKFVVQDDPNTSDFTDPLSGIPKGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 1309 - protein, 223 aa, Homo sapiens
MEDVKLEFPSLPQCKEDAEEWTYPMRREMQEILPGLFLGPYSSAMKSKLPVLQKHGITHIICIRQNIEANFIKPNFQQLFRYLVLDIADNPVENIIRFFPMTKEFIDGSLQMGGKVLVHGNAGISRSAAFVIAYIMETFGMKYRDAFAYVQERRFCINPNAGFVHQLQEYEAIYLAKLTIQMMSPLQIERSLSVHSGTTGSLKRTHEEEDDFGTMQVATAQNG

SEQ ID NO: 1310 - protein, 311 aa, Homo sapiens
MAAENHSFVTKFILVGLTEKSELQLPLFLVFLGIYVVTVLGNLGMITLIGLSSHLHTPMYCFLSSLSFIDFCHSTVITPKMLVNFVTEKNIISYPECMTQLYFFLVFAIAECHMLAAMAYDGYVAICSPLLYSIIISNKACFSLILVVYVIGLICASAHIGCMFRVQFCKFDVINHYFCDLISILKLSCSSTYINELLILIFSGINILVPSLTILSSYIFIIASILRIRYTEGRSKAFSTCSSHISAVSVFFGSAAFMYLQPSSVSSMDQGKVSSVFYTIVVPMLNPLIYSLRNKDVHVALKKTLGKRTFL

SEQ ID NO: 1311 - protein, 480 aa, Homo sapiens
MVAQSLSDAHHALTITLSERLWLGLELLNFTRRKISSDPPPYNFLEAREAALGHRWRMQQEGGPVRSAPCRTGTLEGSRQGSPGHKKRASPKGSLSSAQPHSWMLTPSPLNSHCAHREPISSSPQPVANGPKQKKKSNWRSTTRLRIIRLRDRLEPRPLAILEDYADPFDVQETGEGSAGASGAPEKVPENDGYMEPYEAQKMMAEIRGSKETATQPLPLYDTPYEPEEDGATPEGEGAPWPRESRLPEDDERPPEEYDQPWEWKKERISKAFAVDIKVIKDLPWPPPVGQLDSSPSLPDGDRDISGPASPLPEPSLEDSSAQFEGPEKSCLSPGREEKGRLPPRLSAGNPKSAKPLSMEPSSPLGEWTDPALPLENQVWYHGAISRTDAENLLRLCKEASYLVRNSETSKNDFSLSLKSSQGFMHMKLSRTKNNKYVLGQNSPPFSSVPEIVHHYASRKLPIKGAEHMSLLYPVAIRTL

SEQ ID NO: 1312 - protein, 750 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEVHPSRLQTTDNLLPMSPEEFDEVSRIVGSVEFDSMMNTV

SEQ ID NO: 1313 - protein, 770 aa, Homo sapiens
MAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 1314 - protein, 194 aa, Homo sapiens [sequence omitted]

SEQ ID NO: 1315 - protein, 122 aa, Homo sapiens [sequence omitted]

SEQ ID NO: 1316 - protein, 248 aa, Homo sapiens
MEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTFVKLNKASINMLRIVEPYIAWGYPNLKSVNELIYKRGYGKINKKRIALTDNALIARSLGKYGIICMEDLIHEIYTVGKRFKEANNFLWPFKLSSPRGGMKKKTTHFVEGGDAGNREDQINRLIRRMN

SEQ ID NO: 1317 - protein, 1172 aa, Homo sapiens
MVWRLVLLALWVWPSTQAGHQDKDTTFDLFSISNINRKTIGAKQFRGPDPGVPAYRFVRFDYIPPVNADDLSKITKIMRQKEGFFLTAQLKQDGKSRGTLLALEGPGLSQRQFEIVSNGPADTLDLTYWIDGTRHVVSLEDVGLADSQWKNVTVQVAGETYSLHVGCDLIGPVALDEPFYEHLQAEKSRMYVAKGSARESHFRGLLQNVHLVFENSVEDILSKKGCQQGQGAEINAISENTETLRLGPHVTTEYVGPSSERRPEVCERSCEELGNMVQELSGLHVLVNQLSENLKRVSNDNQFLWELIGGPPKTRNMSACWQDGRFFAENETWVVDSCTTCTCKKFKTICHQITCPPATCASPSFVEGECCPSCLHSVDGEEGWSPWAEWTQCSVTCGSGTQQRGRSCDVTSNTCLGPSIQTRACSLSKCDTRIRQDGGWSHWSPWSSCSVTCGVGNITRIRLCNSPVPQMGGKNCKGSGRETKACQGAPCPIDGRWSPWSPWSACTVTCAGGIRERTRVCNSPEPQYGGKACVGDVQERQMCNKRSCPVDGCLSNPCFPGAQCSSFPDGSWSCGFCPVGFLGNGTHCEDLDECALVPDICFSTSKVPRCVNTQPGFHCLPCPPRYRGNQPVGVGLEAAKTEKQVCEPENPCKDKTHNCHKHAECIYLGHFSDPMYKCECQTGYAGDGLICGEDSDLDGWPNLNLVCATNATYHCIKDNCPHLPNSGQEDFDKDGIGDACDDDDDNDGVTDEKDNCQLLFNPRQADYDKDEVGDRCDNCPYVHNPAQIDTDNNGEGDACSVDIDGDDVFNERDNCPYVYNTDQRDTDGDGVGDHCDNCPLVHNPDQTDVDNDLVGDQCDNNEDIDDDGHQNNQDNCPYISNANQADHDRDGQGDACDPDDDNDGVPDDRDNCRLVFNPDQEDLDGDGRGDICKDDFDNDNIPDIDDVCPENNAISETDFRNFQMVPLDPKGTTQIDPNWVIRHQGKELVQTANSDPGIAVGFDEFGSVDFSGTFYVNTDRDDDYAGFVFGYQSSSRFYVVMWKQVTQTYWEDQPTRAYGYSGVSLKVVNSTTGTGEHLRNALWHTGNTPGQVRTLWHDPRNIGWKDYTAYRWHLTHRPKTGYIRVLVHEGKQVMADSGPIYDQTYAGGRLGLFVFSQEMVYFSDLKYECRDI

SEQ ID NO: 1318 - protein, 1885 aa, Homo sapiens
MSGALLWPLLPLLLLLLSARDGVRAAQPQAPGYLIAAPSVFRAGVEEVISVTIFNSPREVTVQAQLVAQGEPVVQSQGAILDKGTIKLKVPTGLRGQALLKVWGRGWQAEEGPLFHNQTSVTVDGRGASVFIQTDKPVYRPQHRVLISIFTVSPNLRPVNEKLEAYILDPRGSRMIEWRHLKPFCCGITNMSFPLSDQPVLGEWFIFVEMQGHAYNKSFEVQKYVLPKFELLIDPPRYIQDLDACETGTVRARYTFGKPVAGALTINMTVNGVGYYSHEVGRPVLRTTKILGSQDFDICVRDMIPADVPEHFRGRVSIWAMVTSVDGSQQVAFDDSTPVQRQLVDIRYSKDTRKQFKPGLAYVGKVELSYPDGSPAEGVTVQIKAELTPKDNIYTSEVVSQRGLVGFEIPSIPTSAQHVWLETKVMALNGKPVGAQYLPSYLSLGSWYSPSQCYLQLQPPSHPLQVGEEAYFSVKSTCPCNFTLYYEVAARGNIVLSGQQPAHTTQQRSKRAAPALEKPIRLTHLSETEPPPAPEAEVDVCVTSLHLAVTPSMVPLGRLLVFYVRENGEGVADSLQFAVETFFENQVSVTYSANETQPGEVVDLRIRAARGSCVCVAAVDKSVYLLRSGFRLTPAQVFQELEDYDVSDSFGVSREDGPFWWAGLTAQRRRRSSVFPWPWGITKDSGFAFTETGLVVMTDRVSLNHRQDGGLYTDEAVPAFQPHTGSLVAVAPSRHPPRTEKRKRTFFPETWIWHCLNISDPSGEGTLSVKVPDSITSWVGEAVALSTSQGLGIAEPSLLKTFKPFFVDFMLPALIIRGEQVKIPLSVYNYMGTCAEVYMKLSVPKGIQFVGHPGKRHVTKKMCVAPGEAEPIWVVLSFSDLGLNNITAKALAYGDTNCCRDGRSSKHPEENHADRRVPIGVDHVRRSVMVEAEGVPRAYTYSAFFCPSERVHISTPNKYEFQYVQRPLRLTRFDVAVRAHNDARVALSSGPQDTAGMIEIVLGGHQNTRSWISTSKMGEPVASAHTAKILSWDEFRTFWISWRGGLIQVGHGPEPSNESVIVAWTLPRPPEVQFIGFSTGWGSMGEFRIWRKMEVDESYSEAFTLGVPHGAIPGSERATASIIGDVMGPTLNHLNNLLRLPFGCGEQNMIHFAPNVFVLKYLQKTQQLSPEVERETTDYLVQGYQRQLTYKRQDGSYSAFGERDASGSMWLTAFVLKSFAQARSFIFVDPRELAAAKSWIIQQQQADGSFLAVGRVLNKDIQGGIHGIVPLTAYVVVALLETGTASEEERGSTDKARHFLESAAPLAMDPYSCALTTYALTLLRSPAAPEALRKLRSLAIMRDGVTHWSLSNSWDVDKGTFLSFSDRVSQSVVSAEVEMTAYALLTYTLLGDVAAALPVVKWLSQQRNALGGFSSTQDTCVALQALAEYAILSYAGGINLTVSLASTNLDYQETFELHRTNQKVLQTAAIPSLPTGLFVSAKGDGCCLMQIDVTYNVPDPVAKPAFQLLVSLQEPEAQGRPPPMPASAAEGSRGDWPPADDDDPAADQHHQEYKVMLEVCTRWLHAGSSNMAVLEVPLLSGFRADIESLEQLLLDKHMGMKRYEVAGRRVLFYFDEIPSRCLTCVRFRALRECVVGRTSALPVSVYDYYEPAFEATRFYNVSTHSPLARELCAGPACNEVERAPARGPGWFPGESGPAVAPEEGAAIARCGCDHDCGAQGNPVCGSDGVVYASACRLREAACRQAAPLEPAPPSCCALEQRLPASSSSTYGDDLASVAPGPLQQDVKLNGAGLEVEDSDPEPEGEAEDRVTAGPRPPVSSGNLESSTQSASPFHRWGQTPAPQRHSGRVVGAHRPGLLSPVFVYSPAFQSGGEEGLWMSNTCTLR

SEQ ID NO: 1319 - protein, 623 aa, Homo sapiens
MPSDLAKKKAAKKKEAAKARQRPRKGHEENGDVVTEPQVAEKNEANGRETTEVDLLTKELEDFEMKKAAARAVTGVLASHPNSTDVHIINLSLTFHGQELLSDTKLELNSGRRYGLIGLNGIGKSMLLSAIGKREVPIPEHIDIYHLTREMPPSDKTPLHCVMEVDTERAMLEKEAERLAHEDAECEKLMELYERLEELDADKAEMRASRILHGLGFTPAMQRKKLKDFSGGWRMRVALARALFIRPFMLLLDEPTNHLDLDACVWLEEELKTFKRILVLVSHSQDFLNGVCTNIIHMHNKKLKYYTGNYDQYVKTRLELEENQMKRFHWEQDQIAHMKNYIARFGHGSAKLARQAQSKEKTLQKMMASGLTERVVSDKTLSFYFPPCGKIPPPVIMVQNVSFKYTKDGPCIYNNLEFGIDLDTRVALVGPNGAGKSTLLKLLTGELLPTDGMIRKHSHVKIGRYHQHLQEQLDLDLSPLEYMMKCYPEIKEKEEMRKIIGRYGLTGKQQVSPIRNLSDGQKCRVCLAWLAWQNPHMLFLDEPTNHLDIETIDALADAINEFEGGMMLVSHDFRLIQQVAQEIWVCEKQTITKWPGDILAYKEHLKSKLVDEEPQLTKRTHNV

SEQ ID NO: 1320 - protein, 746 aa, Homo sapiens
MAGSRGAGRTAAPSVRPEKRRSEPELEPEPEPEPPLLCTSPLSHSTGSDSGVSDSEESVFSGLEDSGSDSSEDDDEGDEEGEDGALDDEGHSGIKKTTEEQVQASTPCPRTEMASARIGDEYAEDSSDEEDIRNTVGNVPLEWYDDFPHVGYDLDGRRIYKPLRTRDELDQFLDKMDDPDYWRTVQDPMTGRDLRLTDEQVALVRRLQSGQFGDVGFNPYEPAVDFFSGDVMIHPVTNRPADKRSFIPSLVEKEKVSRMVHAIKMGWIQPRRPRDPTPSFYDLWAQEDPNAVLGRHKMHVPAPKLALPGHAESYNPPPEYLLSEEERLAWEQQEPGERKLSFLPRKFPSLRAVPAYGRFIQERFERCLDLYLCPRQRKMRVNVDPEDLIPKLPRPRDLQPFPTCQALVYRGHSDLVRCLSVSPGGQWLVSGSDDGSLRLWEVATARCVRTVPVGGVVKSVAWNPSPAVCLVAAAVEDSVLLLNPALGDRLVAGSTDQLLSAFVPPEEPPLQPARWLEASEEERQVGLRLRICHGKPVTQVTWHGRGDYLAVVLATQGHTQVLIHQLSRRRSQSPFRRSHGQVQRVAFHPARPFLLVASQRSVRLYHLLRQELTKKLMPNCKWVSSLAVHPAGDNVICGSYDSKLVWFDLDLSTKPYRMLRHHKKALRAVAFHPRYPLFASGSDDGSVIVCHGMVYNDLLQNPLLVPVKVLKGHVLTRDLGVLDVIFHPTQPWVFSSGADGTVRLFT

SEQ ID NO: 1321 - protein, 197 aa, Homo sapiens [sequence omitted]

SEQ ID NO: 1322 - protein, 271 aa, Homo sapiens
MSAPRLLISIIIMVSASSSSCMGGKQMTQNYSTIFAEGNISQPVLMDINAVLCCPPIALRNLIIITWEIILRGQPSCTKAYKKETNETKETNCTVERITWVSRPDQNSDLQILPVDTTHDGYYRGIVVTPDGNFHRGYHLQVLVTPEVNLFQSRNITAVCKAVTGKPAAQISWIPEGSILATKQEYWGNGTVTVKSTCPWEGHKSTVTCHVSHLTGNKSLSVKLNSGLRTSGSPALSLLIILYVKLSLFVVILVTTGFVFFQRINHVRKVL

SEQ ID NO: 1323 - protein, 403 aa, Homo sapiens
LGSGSGAPQSCRPLDRARRSGESGATRRAVARMEEAGAAVVTAGEAELNWSRLSVSTETLESELEARGEERRGAREALLRLLLPHNRLVSLPRALGSGFPHLQLLDVSGNALTALGPELLALRGLRTLLAKNNRLGGPSALPKGLAQSPLCRSLQVLNLSGNCFQEVPASLLELRALQTLSLGGNQLQSIPAEIENLQSLECLYLGGNFIKEIPPELGNLPSLNYLVLCDNKIQSIPPQLSQLHSLRSLSLHNNLLTYLPREILNLIHLEELSLRGNPLVVRFVRDLTYDPPTLLELAARTIKIRNISYTPYDLPGNLLRYLGSASNCPNPKCGGVYFDCCVRQIKFVDFCGKYRLPLMHYLCSPECSSPCSSASHSSTSQSESDSEDEASVAARRMQKVLLG

SEQ ID NO: 1324 - protein, 220 aa, Homo sapiens
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAIIRDFYNPLVAEAQKRELGASLYLGWAASGLLLLGGGLLCCTCPSGGSQGPSHYMARYSTSAPAISRGPSEYPTKNYV

SEQ ID NO: 1325 - protein, 607 aa, Homo sapiens
MAEKRRGSPCSMLSLKAHAFSVEALIGAEKQQQLQKKRRKLGAEEAAGAVDDGGCSRGGGAGEKGSSEGDEGAALPPPAGATSGPARSGADLERGAAGGCEDGFQQGASPLASPGGSPKGSPARSLARPGTPLPSPQAPRVDLQGAELWKRFHEIGTEMIITKAGRRMFPAMRVKISGLDPHQQYYIAMDIVPVDNKRYRYVYHSSKWMVAGNADSPVPPRVYIHPDSPASGETWMRQVISFDKLKLTNNELDDQGHIILHSMHKYQPRVHVIRKDCGDDLSPIKPVPSGEGVKAFSFPETVFTTVTAYQNQQITRLKIDRNPFAKGFRDSGRNRMGLEALVESYAFWRPSLRTLTFEDIPGIPKQGNASSSTLLQGTGNGVPATHPHLLSGSSCSSPAFHLGPNTSQLCSLAPADYSACARSGLTLNRYSTSLAETYNRLTNQAGETFAPPRTPSYVGVSSSTSVNMSMGGTDGDTFSCPQTSLSMQISGMSPQLQYIMPSPSSNAFATNQTHQGSYNTFRLHSPCALYGYNFSTSPKLAASPEKIVSSQGSFLGSSPSGTMTDRQMLPPVEGVHLLSSGGQQSFFDSRTLGSLTLSSSQVSAHMV

SEQ ID NO: 1326 - protein, 948 aa, Homo sapiens
MASNSTKSFLADAGYGEQELDANSALMELDKGLRSGKLGEQCEAVVRFPRLFQKYPFPILINSAFLKLADVFRVGNNFLRLCVLKVTQQSEKHLEKILNVDEFVKRIFSVIHSNDPVARAITLRMLGSLASIIPERKNAHHSIRQSLDSHDNVEVEAAVFAAANFSAQSKDFAVGICNKISEMIQGLATPVDLKLKLIPILQHMHHDAILASSARQLLQQLVTSYPSTKMVIVSLHTFTLLAASSLVDTPKQIQLLLQYLKNDPRKAVKRLAIQDLKLLANKTPHTWSRENIQALCECALQTPYDSLKLGMLSVLSTLSGTIAIKHYFSIVPGNVSSSPRSSDLVKLAQECCYHNNRGIAAHGVRVLTNITVSCQEKDLLALEQDAVFGLESLLVLCSQDDSPGAQATLKIALNCMVKLAKGRPRLSQSVVETLLTQLHSAQDAARILMCHCLAAIAMQLPVLGDGMLGDLMELYKVIGRSATDKQQELLVSLATVIFVASQKALSVESKAVIKQQLESVSNGWTVYRIARQASRMGNHDMAKELYQSLLTQVASEHFYFWLNSLKEFSHAEQCLTGLQEENYSSALSCIAESLKFYHKGIASLTAASTPLNPLSFQCEFVKLRIDLLQAFSQLICTCNSLKTSPPPAIATTIAMTLGNDLQRCGRISNQMKQSMEEFRSLASRYGDLYQASFDADSATLRNVELQQQSCLLISHAIEALILDPESASFQEYGSTGTAHADSEYERRMMSVYNHVLEEHTACLCNAIIALLKVPLSFQRYFFQKLQSTSIKLALSPSPRNPAEPIAVQNNQQLALKVEGVVQHGSKPGLFRKIQSVCLNVSSTLQSKSGQDYKIPIDNMTNEMEQRVEPHNDYFSTQFLLNFAILGTHNITVESSVKDANGIVWKTGPRTTIFVKSLEDPYSQQIRLQQQQAQQPLQQQQQRNAYTRF

SEQ ID NO: 1327 - protein, 3169 aa, Homo sapiens
MHSAGTPGLSSRRTGNSTSFQPGPPPPPRLLLLLLLLLSLVSRVPAQPAAFGRALLSPGLAGAAGVPAEEAIVLANRGLRVPFGREVWLDPLHDLVLQVQPGDRCAVSVLDNDALAQRPGRLSPKRFPCDFGPGEVRYSHLGARSPSRDRVRLQLRYDAPGGAVVLPLVLEVEVVFTQLEVVTRNLPLVVEELLGTSNALDARSLEFAFQPETEECRVGILSGLGALPRYGELLHYPQVPGGAREGGAPETLLMDCKAFQELGVRYRHTAASRSPNRDWIPMVVELRSRGAPVGSPALKREHFQVLVRIRGGAENTAPKPSFVAMMMMEVDQFVLTALTPDMLAAEDAESPSDLLIFNLTSPFQPGQGYLVSTDDRSLPLSSFTQRDLRLLKIAYQPPSEDSDQERLFELELEVVDLEGAASDPFAFMVVVKPMNTMAPVVTRNTGLILYEGQSRPLTGPAGSGPQNLVISDEDDLEAVRLEVVAGLRHGHLVILGASSGSSAPKSFTVAELAAGQVVYQHDDRDGSLSDNLVLRMVDGGGRHQVQFLFPITLVPVDDQPPVLNANTGLTLAEGETVPILPLSLSATDMDSDDSLLLFVLESPFLTTGHLLLRQTHPPHEKQELLRGLWRKEGAFYERTVTEWQQQDITEGRLFYRHSGPHSPGPVTDQFTFRVQDNHDPPNQSGLQRFVIRIHPVDRLPPELGSGCPLRMVVQESQLTPLRKKWLRYTDLDTDDRELRYTVTQSPTDTDENHLPAPLGTLVLTDNPSVVVTHFTQAQINHHKIAYRPPGQELGVATRVAQFQFQVEDRAGNVAPGTFTLYLHPVDNQPPEILNTGFTIQEKGHHILSETELHVNDVDTDVAHISFTLTQAPKHGHMRVSGQILHVGGLFHLEDIKQGRVSYAHNGDKSLTDSCSLEVSDRHHVVPITLRVNVRPVDDEVPILSHPTGTLESYLDVLENGATEITANVIKGTNEETDDLMLTFLLEDPPLYGEILVNGIPAEQFTQRDILEGSVVYTHTSGEIGLLPKADSFNLSLSDMSQEWRIGGNTIQGVTIWVTILPVDSQAPEIFVGEQLIVMEGDKSVITSVHISAEDVDSLNDDILCTIVIQPTSGYVENISPAPGSEKSRAGIAISAFNLKDLRQGHINYVQSVHKGVEPVEDRFVFRCSDGINFSERQFFPIVIIPTNDEQPEMFMREFMVMEGMSLVIDTPILNAADADVPLDDLTFTITQFPTHGHIMNQLINGTVLVESFTLDQIIESSSIIYEHDDSETQEDSFVIKLTDGKHSVEKTVLIIVIPVDDETPRMTINNGLEIEIGDTKIINNKILMATDLDSEDKSLVYIIRYGPGHGLLQRRKPTGAFENITLGMNFTQDEVDRNLIQYVHLGQEGIRDLIKFDVTDGINPLIDRYFYVSIGSIDIVFPDVISKGVSLKEGGKVTLTTDLLSTSDLNSPDENLVFTITRAPMRGHLECTDQPGVSITSFTQLQLAGNKIYYIHTADDEVKMDSFEFQVTDGRNPVFRTFRISISDVDNKKPVVTIHKLVVSESENKLITPFELTVEDRDTPDKLLKFTITQVPIHGHLLFNNTRPVMVFTKQDLNENLISYKHDGTESSEDSFSFTVTDGTHTDFYVFPDTVFETRRPQVMKIQVLAVDNSVPQIAVNKGASTLRTLATGHLGFMITSKILKVEDRDSLHISLRFIVTEAPQHGYLLNLDKGNHSITQFTQADIDDMKICYVLREGANATSDMFYFAVEDGGGNKLTYQNFRLNWAWISFEKEYYLVNEDSKFLDVVLKRRGYLGETSFISIGTRDRTAEKDKDFKGKAQKQVQFNPGQTRATWRVRILSDGEHEQSETFQVVLSEPVLAALEFPTVATVEIVDPGDEPTVFIPQSKYSVEEDVGELFIPIRRSGDVSQELMVVCYTQQGTATGTVPTSVLSYSDYISRPEDHTSVVRFDKDEREKLCRIVIIDDSLYEEEETFHVLLSMPMGGRIGSEFPGAQVTIVPDKDDEPIFYFGDVEYSVDESAGYVEVQVWRTGTDLSKSSSVTVRSRKTDPPSADAGTDYVGISRNLDFAPGVNMQPVRVVILDDLGQPALEGIEKFELVLRMPMNAALGEPSKATVSINDSVSDLPKMQFKERIYTGSESDGQIVTMIHRTGDVQYRSSVRCYTRQGSAQVMMDFEERPNTDTSIITFLPGETEKPCILELMDDVLYEEVEELRLVLGTPQSNSPFGAAVGEQNETLIRIRDDADKTVIKFGETKFSVTEPKEPGESVVIRIPVIRQGDTSKVSIVRVHTKDGSATSGEDYHPVSEEIEFKEGETQHVVEIEVTFDGVREMREAFTVHLKPDENMIAEMQLTKAIVYIEEMSSMADVTFPSVPQIVSLLMYDDTSKAKESAEPMSGYPVICITACNPKYSDYDKTGSICASENINDTLTRYRWLISAPAGPDGVTSPMREVDFDTFFTSSKMVTLDSIYFQPGSRVQCAARAVNTNGDEGLELMSPIVTISREEGLCQPRVPGVVGAEPFSAKLRYTGPEDADYTNLIKLTVTMPHIDGMLPVISTRELSNFELTLSPDGTRVGNHKCSNLLDYTEVKTHYGFLTDATKNPEIIGETYPYQYSLSIRGSTTLRFYRNLNLEACLWEFVSYYDMSELLADCGGTIGTDGQVLNLVQSYVTLRVPLYVSYVFHSPVGVGGWQHFDLKSELRLTFVYDTAILWNDGIGSPPEAELQGSLYPTSMRIGDEGRLAVHFKTEAQFHGLFVLSHPASFTSSVIMSADHPGLTFSLRLIRSEPTYNQPVQQWSFVSDFAVRDYSGTYTVKLVPCTAPSHQEYRLPVTCNPREPVTFDLDIRFQQVSDPVAAEFSLNTQMYLLSKKSLWLSDGSMGFGQESDVAFAEGDIIYGRVMVDPVQNLGDSFYCSIEKVFLCTGADGYVPKYSPMNAEYGCLADSPSLLYRFKIVDKAQPETQATSFGNVLFNAKLAVDDPEAILLVNQPGSDGFKVDSTPLFQVALGREWYIHTIYTVRSKDNANRGIGKRSVEYHSLVSQGKPQSTTKSRKKREIRSTPSLAWEIGAENSRGTNIQHIALDRTKRQIPHGRAPPDGILPWELNSPSSAVSLVTVVGGTTVGLLTICLTVIAVLMCRGKESFRGKDAPKGSSSSEPMVPPQSHHNDSSEV

SEQ ID NO: 1328 - protein, 2099 aa, Homo sapiens
MDRDDLTDDSVFTRSSQCSRGLERYISQEEGPLSPFLGQLDEDYRTKETFLHRSDYSPHISCHDELLRGTERNREKLKGYSIRSEERSREAKRPRYDDTVKINSMGGDHPSFTSGTRNYRQRRRSPSPRFLDPEFRELDLARRKREEEEERSRSLSQELVGVDGGGTGCSIPGLSGVLTASEPGYSLHRPEEVSVMPKKSILKKRIEVDIMEPSMQLESFSSSTSSSQDHPLYSGHPSLPLSGAIAAFASEIENKGTMVETALKEPQGNLYQWGPLPGIPKDNSPLREKFGSFLCHKDNLDLKAEGPERHTDFLLPHERASQDGSGFSRILSMLADSTSTQEKRRRSFPDIEDEEKFLYGDEEEDLKAESVPKPLGSSESEVMRQKASSLPSSAPAVKLESLEETNPEYAKIHDLLKTIGLDIGVAEISQLAARTQERLHGKKPSLRSSADRRSSVDRYFSADHCSSVDHRFSADRCSSVDHCFSADRRSSDPHRLESREAHHSNTHSPEVSHPHPPSPVDPYLLTKNSPPFLKSDHPVGHISGPEVVGSGFQSSVAVRCMLPSAPSAPIRLPHTAALSQFHMPRASQFAAARIPPNYQGPAIPPASFDAYRHYMAYAASRWPMYPTSQPSNHPVPEPHRIMPITKQATRSRPNLRVIPTVTPDKPKQKESLRGSIPAAQVPVQVSIPSLIRYNPEKISDEKNRASQKQKVIEEREKLKNDREARQKKMYYLRTELERLHKQQGEMLRKKRREKDGHKDPLLVEVSRLQDNIMKDIAELRQEAEEAEKKQSELDKVAQILGINIFDKSQKSLSDSREPTEKPGKAEKSKSPEKVSSFSNSSSNKESKVNNEKFRTKSPKPAESPQSATKQLDQPTAAYEYYDAGNHWCKDCNTICGTMFDFFTHMHNKKHTQTLDPYNRPWASKTQSEAKQDAIKRTDKITVPAKGSEFLVPISGFYCQLCEEFLGDPISGEQHVKGHQHNEKYKKYVDENPLYEERRNLDRQAGLAVVLETERRRQSELKRKLSEKPKEEKKEKKAKAVKEVKEDDKVSEKLEDQLSEGRNSPEKAENKRNTGIKLQLKEEVKKESPTSSSFGKFSWKKPEKEEEKSSLVTPSISKEEILESSKDKEDGKTEAGKAKPIKIKLSGKTVVAHTSPWMPVVTTSTQTKIRPNLPIPSTVLRKSCSATMSKPAPLNTFLSIKSSGTTAKPLPVVKESSADLLLPPDIISKAFGGEEVILKGSPEEKVVLAEKSEPSHLPEQILPPPPPPPPPPPPPPPVIPHPAAPSAAQANAILAPVKSNPVVSQTLSPGFVGPNILNPVLPVAIMASAQPAAIPSDETAPGVSESDRDQTLFSVLVRPPPPLSSVFSEQAKKLEKRNSCLATANAKDLYDIFYSSGGKGAPETKGAPETKLSGGPLANGENSNLSRTKSSDTSSTSPLNSSASQEELHQDEGLVAAPIVSNSEKPIAKTLVALGKWSVVEHVGPKSTGSTYGFLQPLTRLCQSRPYETITPKTDTLAIWTSSSFQSDTSRDISPEKSELDLGEPGPPGVEPPPQLLDIQCKESQKLVEIHLRESVNQDKESQELRKSEDCRESEIETNTELKERVKELSEGIVDEGVSTSIGPHSIDDSNLNHGNRYMWEGEVKQPNLLMIDKEAEQSNKLMTGSETPSKVVIKLSPQACSFTKAKLDSFLSEARSLLNPQDTPVKISAPELLLHSPARSAMCLTGSPQEQGVSVVSEEGLENSAPESASRTSRYRSLKLKRERSKDFQVKKIYELAVWDENKKRPETWESPEKPKTEALELQDVHPELTVTIESKALEDFEATDLKVEELTALGNLGDMPVDFCTTRVSPAHRSPTVLCQKVCEENSVSPIGCNSSDPADFEPIPSFSGFPLDSPKTLVLDFETEGERNSPNPRSVRIPSPNILKTGLTENVDRGLGGLEGTHQALDLLAGGMMPEEVKESSQLDKQESLGLELKTINSAGLGPSPCLPDLVDFVTRTSGVQKDKLCSPLSEPGDPSKCSSLELGPLQLEISNASTTEVAILQVDDDSGDPLNLVKAPVSRSPPREQVIEDNMVPQGMPEQETTVGAIQDHTESSVHN

SEQ ID NO: 1329 - protein, 913 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKMNKNNAKALSTLRQKIRKYNRDFESHITSYKQNPEQSADEDAEKNEEDSEGSSDEDEDEDGVSAATFLKKKSEAPSGESRKFLKKMDDEDEDSEDSEDDEDWDTGSTSSDSDSEEEEGKQTALASRFLKKAPTTDEDKKAAEKKREDKAKKKHDRKSKRLDEEEEDNEGGEWERVRGGVPLVKEKPKMFAKGTEITHAVVIKKLNEILQARGKKGTDRAAQIELLQLLVQIAAENNLGEGVIVKIKFNIIASLYDYNPNLATYMKPEMWGKCLDCINELMDILFANPNIFVGENILEESENLHNADQPLRVRGCILTLVERMDEEFTKIMQNTDPHSQEYVEHLKDEAQVCAIIERVQRYLEEKGTTEEVCRIYLLRILHTYYKFDYKAHQRQLTPPEGSSKSEQDQAENEGEDSAVLMERLCKYIYAKDRTDRIRTCAILCHIYHHALHSRWYQARDLMLMSHLQDNIQHADPPVQILYNRTMVQLGICAFRQGLTKDAHNALLDIQSSGRAKELLGQGLLLRSLQERNQEQEKVERRRQVPFHLHINLELLECVYLVSAMLLEIPYMAAHESDARRRMISKQFHHQLRVGERQPLLGPPESMREHVVAASKAMKMGDWKTCHSFIINEKMNGKVWDLFPEADKVRTMLVRKIQEESLRTYLFTYSSVYDSISMETLSDMFELDLPTVHSIISKMIINEELMASLDQPTQTVVMHRTEPTAQQNLALQLAEKLGSLVENNERVFDHKQGTYGGYFRDQKDGYRKNEGYMRRGGYRQQQSQTAY

SEQ ID NO: 1330 - protein, 215 aa, Homo sapiens [sequence omitted]

SEQ ID NO: 1331 - protein, 872 aa, Homo sapiens
MAPASASGEDLRKLPTMAEVNGEQDFIDLTRETRPRTKDRSGLYVIDLTRAEGENRPIATLDLTLEPVTPSQKEPTSLQTCASLSGKAVMEGHVDRSSQPTARRIINSDPVDLDLVEENTFVGPPPATSISGGSVYPTEPNCSSATFTGNLSFLASLQLSSDVSSLSPTSNNSRSSSSSSNQKAPLPCPQQDVSRPPQALPCPLRPLPCPPRASPCPPRASSCPPRALSCPSQTMQCQLPALTHPPQEVPCPRQNIPGPPQDSLGLPQDVPGLPQSILHPQDVAYLQDMPRSPGDVPQSPSDVSPSPDAPQSPGGMPHLPGDVLHSPGDMPHSSGDVTHSPRDIPHLPGDRPDFTQNDVQNRDMPMDISALSSPSCSPRPQSETPLEKVPWLSVMETPARKEISLSEPAKPGSAHVQSRTPQGGLYNRPCLHRLKYFLRPPVHHLFFQTLIPDKDTRENKGQRLEPIPHRRLRMVTNTIEENFPLGTVQFLMDFVSPQHYPPREIVAHIIQKILLSGSETVDVLKEAYMLLMKIQQLHPANAKTVEWDWKLLTYVMEEEGQTLPGRVLFLRYVVQTLEDDFQQTLRRQRQHLQQSIANMVLSCDKQPHNVRDVIKWLVKAVTEDGLTQPPNGNQTSSGTGILKASSSHPSSQPNLTKNTNQLIVCQLQRMLSIAVEVDRTPTCSSNKIAEMMFGFVLDIPERSQREMFFTTMESHLLRCKVLEIIFLHSCETPTRLPLSLAQALYFLNNSTSLLKCQSDKSQWQTWDELVERLQFLLSSYQHVLREHLRSSVIDRKDLIIKRIKPKPQQGDDITVVDVEKQIEAFRSRLIQMLGEPLVPQLQDKVHLLKLLLFYAADLNPDAEPFQKGWSGS

SEQ ID NO: 1332 - protein, 723 aa, Homo sapiens; identical to SEQ ID NO: 794

SEQ ID NO: 1333 - protein, 1454 aa, Homo sapiens
MESSSSDYYNKDNEEESLLANVASLRHELKITEWSLQSLGEELSSVSPSENSDYAPNPSRSEKLILDVQPSHPGLLNYSPYENVCKISGSSTDFQKKPRDKMFSSSAPVDQEIKSLREKLNKLRQQNACLVTQNHSLMTKFESIHFELTQSRAKVSMLESAQQQAASVPILEEQIINLEAEVSAQDKVLREAENKLEQSQKMVIEKEQSLQESKEECIKLKVDLLEQTKQGKRAERQRNEALYNAEELSKAFQQYKKKVAEKLEKVQAEEEILERNLTNCEKENKRLQERCGLYKSELEILKEKLRQLKEENNNGKEKLRIMAVKNSEVMAQLTESRQSILKLESELENKDEILRDKFSLMNENRELKVRVAAQNERLDLCQQEIESSRVELRSLEKIISQLPLKRELFGFKSYLSKYQMSSFSNKEDRCIGCCEANKLVISELRIKLAIKEAEIQKLHANLTANQLSQSLITCNDSQESSKLSSLETEPVKLGGHQVESVKDQNQHTMNKQYEKERQRLVTGIEELRTKLIQIEAENSDLKVNMAHRTSQFQLIQEELLEKASNSSKLESEMTKKCSQLLTLEKQLEEKIVAYSSIAAKNAELEQELMEKNEKIRSLETNINTEHEKICLAFEKAKKIHLEQHKEMEKQIERLEAQLEKKDQQFKEQEKTMSMLQQDIICKQHHLESLDRLLTESKGEMKKENMKKDEALKALQNQVSEETIKVRQLDSALEICKEELVLHLNQLEGNKEKFEKQLKKKSEEVYCLQKELKIKNHSLQETSEQNVILQHTLQQQQQMLQQETIRNGELEDTQTKLEKQVSKLEQELQKQRESSAEKLRKMEEKCESAAHEADLKRQKVIELTGTARQVKIEMDQYKEELSKMEKEIMHLKRDGENKAMHLSQLDMILDQTKTELEKKTNAVKELEKLQHSTETELTEALQKREVLETELQNAHGELKSTLRQLQELRDVLQKAQLSLEEKYTTIKDLTAELRECKMEIEDKKQELLEMDQALKERNWELKQRAAQVTHLDMTIREHRGEMEQKIIKLEGTLEKSELELKECNKQIESLNDKLQNAKEQLREKEFIMLQNEQEISQLKKEIERTQQRMKEMESVMKEQEQYIATQYKEAIDLGQELRLTREQVQNSHTELAEARHQQVQAQREIERLSSELEDMKQLSKEKDAHGNHLAEELGASKVREAHLEARMQAEIKKLSAEVESLKEAYHMEMISHQENHAKWKISADSQKSSVQQLNEQLEKAKLELEEAQDTVSNLHQQVQDRNEVIEAANEALLTKESELTRLQAKISGHEKAEDIKFLPAPFTSPTEIMPDVQDPKFAKCFHTSFSKCTKLRRSISASDLTFKIHGDEDLSEELLQDLKKMQLEQPSTLEESHKNLTYTQPDSFKPLTYNLEADSSENNDFNTLSGMLRYINKEVRLLKKSSMQTGAGLNQGENV

SEQ ID NO: 1334 - protein, 330 aa, Homo sapiens
MAPEENAGTELLLQSFERRFLAARTLRSFPWQSLEAKLRDSSDSELLRDILHKTVKHPVCVKHPPSVKYARCFLSELIKKHEAVHTEPLDELYEALAETLMAKESTQGHRSYLLPSGGSVTLSESTAIISYGTTGLVTWDAALYLAEWAIENPAVFTNRTVLELGSGAGLTGLAICKMCRPRAYIFSDCHSRVLEQLRGNVLLNGLSLEADITAKLDSPRVTVAQLDWDVATVHQLSAFQPDVVIAADVLYCPEAIMSLVGVLRRLAACREHQRAPEVYVAFTVRNPETCQLFTTELGRAGIRWEVEPRHEQKLFPYEEHLEMAMLNLTL

SEQ ID NO: 1335 - protein, 242 aa, Homo sapiens
MRPLSMSGHFLLAPIPESSSDYLLPKDIKLAVLGAGRVGKSAMIVRFLTKRFIGDYEPNTGKLYSRLVYVEGDQLSLQIQDTPGGVQIQDSLPQVVDSLSKCVQWAEGFLLVYSITDYDSYLSIRPLYQHIRKVHPDSKAPVIIVGNKGDLLHARQVQTQDGIQLANELGSLFLEISTSENYEDVCDVFQHLCKEVSKMHGLSGERRRASIIPRPRSPNMQDLKRRFKQALSPKVKAPSALG

SEQ ID NO: 1336 - protein, 429 aa, Homo sapiens
SFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLETEIEALKEELLFMKKNHEEEVKGLQAQIASSGLTVEVDAPKSQDLAKIMADIRAQYDELARKNREELDKYWSQQIEESTTVVTTQSAEVGAAETTLTELRRTVQSLEIDLDSMRNLKASLENSLREVEARYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLRH

SEQ ID NO: 1337 - protein, 771 aa, Homo sapiens
MTANRLAESLLALSQQEELADLPKDYLLSESEDEGDNDGERKHQKLLEAISSLDGKNRRKLAERSEASLKVSEFNVSSEGSGEKLVLADLLEPVKTSSSLATVKKQLSRVKSKKTVELPLNKEEIERIHREVAFNKTAQVLSKWDPVVLKNRQAEQLVFPLEKEEPAIAPIEHVLSGWKARTPLEQEIFNLLHKNKQPVTDPLLTPVEKASLRAMSLEEAKMRRAELQRARALQSYYEAKARREKKIKSKKYHKVVKKGKAKKALKEFEQLRKVNPAAALEELEKIEKARMMERMSLKHQNSGKWAKSKAIMAKYDLEARQAMQEQLSKNKELTQKLQVASESEEEEGGTEDVEELLVPDVVNEVQMNADGPNPWMLRSCTSDTKEAATQEDPEQLPELEAHGVSESEGEERPVAEEEILLREFEERRSLRKRSELSQDAEPAGSQETKDSGSQEVLSELRVLSQKLKENHQSRKQKASSEGTIPQVQREEPAPEEEEPLLLQRPERVQTLEELEELGKEECFQNKELPRPVLEGQQSERTPNNRPDAPKEKKKKEQMIDLQNLLTTQSPSVKSLAVPTIEELEDEEERNHRQMIKEAFAGDDVIRDFLKEKREAVEASKPKDVDLTLPGWGEWGGVGLKPSAKKRRRFLIKAPEGPPRKDKNLPNVIINEKRNIHAAAHQVRVLPYPFTHHWQFERTIQTPIGSTWNTQRAFQKLTTPKVVTKPGHIINPIKAEDVGYRSSSRSDLSVIQRNPKRITTRHKKQLKKCSVD

SEQ ID NO: 1338 - protein, 292 aa, Homo sapiens [sequence omitted]

SEQ ID NO: 1339 - protein, 1232 aa, Homo sapiens
MKEEVKGIPVRVALRCRPLVPKEISEGCQMCLSFVPGEPQVVVGTDKSFTYDFVFDPSTEQEEVFNTAVAPLIKGVFKGYNATVLAYGQTGSGKTYSMGGAYTAEQENEPTVGVIPRVIQLLFKEIDKKSDFEFTLKVSYLEIYNEEILDLLCPSREKAQINIREDPKEGIKIVGLTEKTVLVALDTVSCLEQGNNSRTVASTAMNSQSSRSHAIFTISLEQRKKSDKNSSFRSKLHLVDLAGSERQKKTKAEGDRLKEGININRGLLCLGNVISALGDDKKGGFVPYRDSKLTRLLQDSLGGNSHTLMIACVSPADSNLEETLNTLRYADRARKIKNKPIVNIDPQTAELNHLKQQVQQLQVLLLQAHGGTLPGSITVEPSENLQSLMEKNQSLVEENEKLSRGLSEAAGQTAQMLERIILTEQANEKMNAKLEELRQHAACKLDLQKLVETLEDQELKENVEIICNLQQLITQLSDETVACMAAAIDTAVEQEAQVETSPETSRSSDAFTTQHALRQAQMSKELVELNKALALKEALARKMTQNDSQLQPIQYQYQDNIKELELEVINLQKEKEELVLELQTAKKDANQAKLSERRRKRLQELEGQIADLKKKLNEQSKLLKLKESTERTVSKLNQEIRMMKNQRVQLMRQMKEDAEKFRQWKQKKDKEVIQLKERDRKRQYELLKLERNFQKQSNVLRRKTEEAAAANKRLKDALQKQREVADKRKETQSRGMEGTAARVKNWLGNEIEVMVSTEEAKRHLNDLLEDRKILAQDVAQLKEKKESGENPPPKLRRRTFSLTEVRGQVSESEDSITKQIESLETEMEFRSAQIADLQQKLLDAESEDRPKQRWENIATILEAKCALKYLIGELVSSKIQVSKLESSLKQSKTSCADMQKMLFEERNHFAEIETELQAELVRMEQQHQEKVLYLLSQLQQSQMAEKQLEESVSEKEQQLLSTLKCQDEELEKMREVCEQNQQLLRENEIIKQKLTLLQVASRQKHLPKDTLLSPDSSFEYVPPKPKPSRVKEKFLEQSMDIEDLKYCSEHSVNEHEDGDGDDDEGDDEEWKPTKLVKVSRKNIQGCSCKGWCGNKQCGCRKQKSDCGVDCCCDPTKCRNRQQGKDSLGTVERTQDSEGSFKLEDPTEVTPGLSFFNPVCATPNSKILKEMCDVEQVLSKKTPPAPSPFDLPELKHVATEYQENKAPGKKKKRALASNTSFFSGCSPIEEEAH

SEQ ID NO: 1340 - protein, 814 aa, Homo sapiens
MVKQTIQIFARVKPPVRKHQQGIYSIDEDEKLIPSLEIILPRDLADGFVNNKRESYKFKFQRIFDQDANQETVFENIAKPVAGSVLAGYNGTIFAYGQTGSGKTFTITGGAERYSDRGIIPRTLSYIFEQLQKDSSKIYTTHISYLEIYNECGYDLLDPRHEASSLEDLPKVTILEDPDQNIHLKNLTLHQATTEEEALNLLFLGDTNRMIAETPMNQASTRSHCIFTIHLSSKEPGSATVRHAKLHLVDLAGSERVAKTGVGGHLLTEAKYINLSLHYLEQVIIALSEKHRSHIPYRNSMMTSVLRDSLGGNCMTTMIATLSLEKRNLDESISTCRFAQRVALIKNEAVLNEEINPRLVIKRLQKEIQELKDELAMVTGEQRTEALTEAELLQLEKLITSFLEDQDSDSRLEVGADMRKVHHCFHHLKKLLNDKKILENNTVSSESKDQDCQEPLKEEEYRKLRDILKQRDNEINILVNMLKKEKKKAQEALHLAGMDRREFRQSQSPPFRLGNPEEGQRMRLSSAPSQAQDFSILGKRSSLLHKKIGMREEMSLGCQEAFEIFKRDHADSVTIDDNKQILKQRFSEAKALGESINEARSKIGHLKEEITQRHIQQVALGISENMAVPLMPDQQEEKLRSQLEEEKRRYKTMFTRLKALKVEIEHLQLLMDKAKVKLQKEFEVWWAEEATNLQVNSPAVNSLDHTKPFLQTSDSQHERSQLLSNKSSGGWEVQDQGTGRFDVCDVNARKILPSPCPSPHSQKQSSTSTPLEDSIPKRPVSSIPLTGDSQTDSDIIAFIKARQSILQKQCLGSN

SEQ ID NO: 1341 - protein, 1976 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGCLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 1342 - protein, 973 aa, Homo sapiens
METKVHLFCQAEENIDLLDDGSNSFATDLSSGTINHKKYIKFSKTIEKEISPEIRSLSPEYKKIFETSIIFCGEEKSSDFSGEKKVGRKSLQVQQHSKRTEIIPPFLKLSKEKVTRKENSLCKLPNQYSVHKTSSPLCTSSAITREKEMLSNLYMTLYDEVTHGYLHSKELSALHKACKIFSKIRSGKIYVNDLPVILCILRISISDLEMRQALKTVDIDAFQDALKIFCRIKGGRVSTDDVFAVLDSMGIPINREILEEVTKHTYIDSNHMVDIGDIIFTLNELQEQYEDVSITEGSPLNEITSDRKLSSVAGCYLKYKKKNSLSSKLPEPSISKKLNKKSNQYYSKIMENDDLESKRPKNTWQIRKFLGGVGSSNVGVQEPYSKNGINFKKHSEKGEIHDSKSKPQSLKSSTSLSKSLDKSDISSIPKLQKPAVRKHSSLQKQVSSTEKTAISTLENFCEAISKLQENYIAAEELQSILPSTGINLLDEEFQKIVTDTSRNENGMVELDDFVNALAKERSFPECNALPGVIKAIDKIKDKNVDYEDLNTCLQNFGIYLSKPEFKKITELTEAGETKKVNFKEFIDTMMSNTECFSEKLVLPDAIETLDDLRKETVSVSDLWNTLSSLNSNLKKDEFLAALELVTVDEGDKVQFEEFAKVVRNMRDAARLEELQEVVLAADLLEGDMIAGKNLEDFLRNVGIKSPKEEVEKILQSDFVSEDNMVNIKDCMRALRDTQKFSNYIDFRKEASNLKLPKVNEIKEAANILSHVDNGKIGIPDLEHALKCLNVNLTEEDFNEALNCCNVSDNMEVDLKDFLMKMKESPHFQKSKATQILLATTQILQNDLVDVSDLKTLLMDKDLHTANAILTVMLRHVPEHESGKVSIQEFMTKLSDILTIPKAAGKFYLICTYCPDLERQAVVYMLKTIQDSIVKAQVSKKQYNMNIKQHKISLHNFCLNSKANIAKLNPNSKF

SEQ ID NO: 1343 - protein, 633 aa, Homo sapiens
AALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTELQRTLSLKLTTLKEIGKTFLRISKRQKLIQVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMVYLARKEGSSFAYISWKFECGSVGLKVDSISIRTSSQTFQTGTVEWKLRSDTAQVELTGDNSLHSYADFSGATEVILEAELSRGDGDVAWQHTQLFRQSLNDHEENCLEIIIKFSDL

SEQ ID NO: 1344 - protein, 164 aa, Homo sapiens
VNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 1345 - protein, 307 aa, Homo sapiens
MEASRWWLLVTVLMAGAHCVALVDQEASDLIHSGPQDSSPGPALPCHKISVSNIDFAFKLYRQLALNAPGENILFFPVSISLALAMLSWGAPVASRTQLLEGLGFTLTVVPEEEIQEGFWDLLIRLRGQGPRLLLTMDQRRFSGLGARANQSLEEAQKHIDEYTEQQTQGKLGAWEKDLGSETTAVLVNHMLLRAEWMKPFDSHATSPKEFFVDEHSAVWVPMMKEKASHRFLHDRELQCSVLRMDHAGNTTTFFIFPNRGKMRHLEDALLPETLIKWDSLLRTRELDFHFPKFSISRTCRLEMLLP

SEQ ID NO: 1346 - protein, 294 aa, Homo sapiens
SGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMPDLYFYRDPEEIEKEEQAAAEKAVTKEEFQGEWTAPAPEFTATQPEVADWSEGVQVPSVPIQQFPTEDWSAQPATEDWSAAPTAQATEWVGATTDWS

SEQ ID NO: 1347 - protein, 305 aa, Homo sapiens
MAAGLARLLLLLGLSAGGPAPAGAAKMKVVEEPNAFGVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKVELACGKSNRLAHVSEPSTCVYALTFETPLVCHPHALLVYPTLPEALQRQWDQVEQDLADELITPQGHEKLLRTLFEDAGYLKTPEENEPTQLEGGPDSLGFETLENCRKAHKELSKEIKRLKGLLTQHGIPYTRPTETSNLEHLGHETPRAKSPEQLRGDPGLRGSL

SEQ ID NO: 1348 - protein, 1011 aa, Homo sapiens
MMSDASDMLAAALEQMDGIIAGSKALEYSNGIFDCQSPTSPFMGSLRALHLVEDLRGLLEMMETDEKEGLRCQIPDSTAETLVEWLQSQMTNGHLPGNGDVYQERLARLENDKESLVLQVSVLTDQVEAQGEKIRDLEFCLEEHREKVNATEEMLQQELLSRTSLETQKLDLMAEISNLKLKLTAVEKDRLDYEDKFRDTEGLIQEINDLRLKVSEMDSERLQYEKKLKSTKSLMAKLSSMKIKVGQMQYEKQRMEQKWESLKDELASLKEQLEEKESEVKRLQEKLVCKMKGEGVEIVDRDIEVQKMKKAVESLMAANEEKDRKIEDLRQCLNRYKKMQDTVVLAQGKDGEYEELLNSSSISSLLDAQGFSDLEKSPSPTPVMGSPSCDPFNTSVPEEFHTTILQVSIPSLLPATVSMETSEKSKLTPKPETSFEENDGNIILGATVDTQLCDKLLTSSLQKSSSLGNLKKETSDGEKETIQKTSEDRAPAESRPFGTLPPRPPGQDTSMDDNPFGTRKVRSSFGRGFFKIKSNKRTASAPNLAETEKETAEHLDLAGASSRPKDSQRNSPFQIPPPSPDSKKKSRGIMKLFGKLRRSQSTTFNPDDMSEPEFKRGGTRATAGPRLGWSRDLGQSNSDLDMPFAKWTKEQVCNWLMEQGLGSYLNSGKHWIASGQTLLQASQQDLEKELGIKHSLHRKKLQLALQALGSEEETNHGKLDFNWVTRWLDDIGLPQYKTQFDEGRVDGRMLHYMTVDDLLSLKVVSVLHHLSIKRAIQVLRINNFEPNCLRRRPSDENTIAPSEVQKWTNHRVMEWLRSVDLAEYAPNLRGSGVHGGLMVLEPRFNVETMAQLLNIPPNKTLLRRHLATHFNLLIGAEAQHQKRDAMELPDYVLLTATAKVKPKKLAFSNFGNLRKKKQEDGEEYVCPMELGQASGSASKKGFKPGLDMRLYEEDDLDRLEQMEDSEGTVRQIGAFSEGINNLTHMLKEDDMFKDFAARSPSASITDEDSNV

SEQ ID NO: 1349 - protein, 263 aa, Homo sapiens
AVGKNKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFELGKLMELHGEGSSSGKATGDETGAKVERADGYEPPVQESV

SEQ ID NO: 1350 - protein, 300 aa, Homo sapiens
FCACESLSPCSGLSSLAARQGYHQIWAFPFLPSGATATWPAASRSRSLAARSLPRSPTRPGPNDALLGEHDFRGQGVRAQRFRFSEEPGPGADGAVLEVHVPQVLHLQYGMYVWPCAVVLAQYLWFHRRSLPGKAILEIGAGVSLPGILAAKCGAEVILSDSSELPHCLEVCRQSCQMNNLPHLQVVGLTWGHISWDLLALPPQDIILASDVFFEPEDFEDILATIYFLMHKNPKVQLWSTYQVRSAGWSLEALLYKWDMKCVHIPLESFDADKEDIAESTLPGRHTVEMLVISFAKDSL

SEQ ID NO: 1351 - protein, 117 aa, Homo sapiens
MAYGVPRKNTVKTILRGSCYNVQEPWDIALLAKTWYTNLANIKLPFLEEISFGGSVQLTKCTTIKDGLLPSAESIKLEREYEVKRLCKLKCQENTSKEIQLLLRERPAGLRRPLPSK

SEQ ID NO: 1352 - protein, 195 aa, Homo sapiens
MAVSQGDGTLCFVLLLCCWQETELRPRTVIPGSPTEIPFSSKQEDMSELLDEILVQEILDLNKTTPSEMPSTASTLSTPLHAGIDENYQAGGSENYHELLENLQFSPGIEDKISNDEANANANLHGDPSENYRGPQVSPGSEKSVSSKEKNSKNTQYENLSILDQILQNIGRSSGNIFHKEQQRTSAQRRSQGSQ

SEQ ID NO: 1353 - protein, 137 aa, Homo sapiens
MGLRAGGTLGRAGAGRGAPEGPGPSGGAQGGSIHSGRIAAVHNVPLSVLIRPLPSVLDPAKVQSLVDTIREDPDSVPPIDVLWIKGAQGGDYFYSFGGCHRYAAYQQLQRETIPAKLVQSTLSDLRVYLGASTPDLQ

SEQ ID NO: 1354 - protein, 904 aa, Homo sapiens
MPQLLRNVLCVIETFHKYASEDSNGATLTGRELKQLIQGEFGDFFQPCVLHAVEKNSNLLNIDSNGIISFDEFVLAIFNLLNLCYLDIKSLLSSELRQVTKPEKEKLDDVDVQATTGDGQWTVGTSPTQEKRMLPSGMASSSQLIPEESGAVGNNRVDPWREAKTHNFPGEASEHNDPKNKHLEGDEQSQEVAQDIQTTEDNEGQLKTNKPMAGSKKTSSPTERKGQDKEISQEGDEPAREQSVSKIRDQFGEQEGNLATQSSPPKEATQRPCEDQEVRTEKEKHSNIQEPPLQREDEPSSQHADLPEQAAARSPSQTQKSTDSKDVCRMFDTQEPGKDADQTPAKTKNLGEPEDYGRTSETQEKECETKDLPVQYGSRNGSETSDMRDERKERRGPEAHGTAGQKERDRKTRPLVLETQTQDGKYQELQGLSKSKDAEKGSETQYLSSEGGDQTHPELEGTAVSGEEAEHTKEGTAEAFVNSKNAPAAERTLGARERTQDLAPLEKQSVGENTRVTKTHDQPVEEEDGYQGEDPESPFTQSDEGSSETPNSLASEEGNSSSETGELPVQGDSQSQGDQHGESVQGGHNNNPDTQRQGTPGEKNRALEAVVPAVRGEDVQLTEDQEQPARGEHKNQGPGTKGPGAAVEPNGHPEAQESTAGDENRKSLEIEITGALDEDFTDQLSLMQLPGKGDSRNELKVQGPSSKEEKGRATEAQNTLLESLDEDNSASLKIQLETKEPVTSEEEDESPQELAGEGGDQKSPAKKEHNSSVPWSSLEKQMQRDQEPCSVERGAVYSSPLYQYLQEKILQQTNVTQEEHQKQVQIAQASGPELCSVSLTSEISDCSVFFNYSQASQPYTRGLPLDESPAGAQETPAPQALEDKQGHPQRERLVLQREASTTKQ

SEQ ID NO: 1355 - protein, 330 aa, Homo sapiens; identical to SEQ ID NO: 1334

SEQ ID NO: 1356 - protein, 910 aa, Homo sapiens
MKKMSRNVLLQMEEEEDDDDGDIVLENLGQTIVPDLGSLESQHDFRTPEFEEFNGKPDSLFFNDGQRRIDFVLVYEDESRKETNKKGTNEKQRRKRQAYESNLICHGLQLEATRSVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRIVYFILSRVKYQVINNVSKFGINRLVNSGIYKAAFPLHDCKFRRQSEDPSCPNERYLLYREWAHPRSIYKKQPLDLIRKYYGEKIGIYFAWLGYYTQMLLLAAVVGVACFLYGYLNQDNCTWSKEVCHPDIGGKIIMCPQCDRLCPFWKLNITCESSKKLCIFDSFGTLVFAVFMGVWVTLFLEFWKRRQAELEYEWDTVELQQEEQARPEYEARCTHVVINEITQEEERIPFTAWGKCIRITLCASAVFFWILLIIASVIGIIVYRLSVFIVFSAKLPKNINGTDPIQKYLTPQTATSITASIISFIIIMILNTIYEKVAIMITNFELPRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLALIIVMEHVIYSVKFFISYAIPDVSKRTKSKIQREKYLTQKLLHENHLKDMTKNMGVIAERMIEAVDNNLRPKSE

SEQ ID NO: 1357 - protein, 490 aa, Homo sapiens
MFLHWLVGMVYVFYFASFILLLREVLRPGVLWFLRNLNDPDFNPVQEMIHLPIYRHLRRFILSVIVFGSIVLLMLWLPIRIIKSVLPNFLPYNVMLYSDAPVSELSLELLLLQVVLPALLEQGHTKQWLKGLVRAWTVTAGYLLDLHSYLLGDQEENENSANQQVNNNQHARNNNAIPVVGEGLHAAHQAILQQGGPVGFQLYRRPLNFPLRIFLLIVFMCITLLIASLICLTLPVFAGRWLMSFWTGTAKIHELYTAACGLYVCWLTIRAVTVMVAWMPQGRRVIFQKVKEWSLMIMKTLIVAVLLAGVVPLLLGLLFELVIVAPLRVPLDQTPLFYPWQDWALGVLHAKIIAAITLMGPQWWLKTVIEQVYANGIRNIDLHYIVRKLAAPVISVLLLSLCVPYVIASGVVPLLGVTAEMQNLVHRRIYPFLLMVVVLMAILSFQVRQFKRLYEHIKNDKYLVGQRLVNYERKSGKQGSSPPPPQSSQE

SEQ ID NO: 1358 - protein, 438 aa, Homo sapiens
MIRKLFIVLLLLLVTIEEARMSSLSFLNIEKTEILFFTKTEETILVSSSYENKRPNSSHLFVKIEDPKILQMVNVAKKISSDATNFTINLVTDEEGETNVTIQLWDSEGRQERLIEEIKNVKVKVLKQKDSLLQAPMHIDRNILMLILPLILLNKCAFGCKIELQLFQTVWKRPLPVILGAVTQFFLMPFCGFLLSQIVALPEAQAFGVVMTCTCPGGGGGYLFALLLDGDFTLAILMTCTSTLLALIMMPVNSYIYSRILGLSGTFHIPVSKIVSTLLFILVPVSIGIVIKHRIPEKASFLERIIRPLSFILMFVGIYLTFTVGLVFLKTDNLEVILLGLLVPALGLLFGYSFAKVCTLPLPVCKTVAIESGMLNSFLALAVIQLSFPQSKANLASVAPFTVAMCSGCEMLLIILVYKAKKRCIFFLQDKRKRNFLI

SEQ ID NO: 1359 - protein, 783 aa, Homo sapiens
MVIMSEFSADPAGQGQGQQKPLRVGFYDIERTLGKGNFAVVKLARHRVTKTQVAIKIIDKTRLDSSNLEKIYREVQLMKLLNHPHIIKLYQVMETKDMLYIVTEFAKNGEMFDYLTSNGHLSENEARKKFWQILSAVEYCHDHHIVHRDLKTENLLLDGNMDIKLADFGFGNFYKSGEPLSTWCGSPPYAAPEVFEGKEYEGPQLDIWSLGVVLYVLVCGSLPFDGPNLPTLRQRVLEGRFRIPFFMSQDCESLIRRMLVVDPARRITIAQIRQHRWMRAEPCLPGPACPAFSAHSYTSNLGDYDEQALGIMQTLGVDRQRTVESLQNSSYNHFAAIYYLLLERLKEYRNAQCARPGPARQPRPRSSDLSGLEVPQEGLSTDPFRPALLCPQPQTLVQSVLQAEMDCELQSSLQWPLFFPVDASCSGVFRPRPVSPSSLLDTAISEEARQGPGLEEEQDTQESLPSSTGRRHTLAEVSTRLSPLTAPCIVVSPSTTASPAEGTSSDSCLTFSASKSPAGLSGTPATQGLLGACSPVRLASPFLGSQSATPVLQAQGGLGGAVLLPVSFQEGRRASDTSLTQGLKAFRQQLRKTTRTKGFLGLNKIKGLARQVCQAPASRASRGGLSPFHAPAQSPGLHGGAAGSREGWSLLEEVLEQQRLLQLQHHPAAAPGCSQAPQPAPAPFVIAPCDGPGAAPLPSTLLTSGLPLLPPPLLQTGASPVASAAQLLDTHLHIGTGPTALPAVPPPRLARLAPGCEPLGLLQGDCEMEDLMPCSLGTFVLVQ

SEQ ID NO: 1360 - protein, 101 aa, Homo sapiens [sequence omitted]

SEQ ID NO: 1361 - protein, 516 aa, Homo sapiens
MEANWTAFLFQAHEASHHQQQAAQNSLLPLLSSAVEPPDQKPLLPIPITQKPQGAPETLKDAIGIKKEKPKTSFVCTYCSKAFRDSYHLRRHESCHTGIKLVSRPKKTPTTVVPLISTIAGDSSRTSLVSTIAGILSTVTTSSSGTNPSSSASTTAMPVTQSVKKPSKPVKKNHACEMCGKAFRDVYHLNRHKLSHSDEKPFECPICNQRFKRKDRMTYHVRSHEGGITKPYTCSVCGKGFSRPDHLSCHVKHVHSTERPFKCQTCTAAFATKDRLRTHMVRHEGKVSCNICGKLLSAAYITSHLKTHGQSQSINCNTCKQGISKTCMSEETSNQKQQQQQQQQQQQQQHVTSWPGKQVETLRLWEEAVKARKKEAANLCQTSTAATTPVTLTTPFSITSSVSSETMSNPVTVAAAMSMRSPVNVSSAVNITSPMNIGHPVTITSPLSMTSPLTLTTPVNLPTPVTAPVNIAHPVTITSPMNLPTPMTLAAPLNIAMRPVESMPFLPQALPTSPPW

SEQ ID NO: 1362 - protein, 1529 aa, Homo sapiens
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSAKEQYFIPGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 1363 - protein, 783 aa, Homo sapiens [sequence omitted]

SEQ ID NO: 1364 - protein, 1560 aa, Homo sapiens
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGRLQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 1365 - protein, 294 aa, Homo sapiens; identical to SEQ ID NO: 1346

SEQ ID NO: 1366 - protein, 294 aa, Homo sapiens; identical to SEQ ID NO: 1346

SEQ ID NO: 1367 - protein, 504 aa, Homo sapiens
MGAGGPRRGEGPPDGGWGWVVLGACFVVTGFAYGFPKAVSVFFRALMRDFDAGYSDTAWVSSIMLAMLYGTGPVSSILVTRFGCRPVMLAGGLLASAGMILASFATRLLELYLTAGVLTGLGLALNFQPSLIMLGLYFERRRPLANGLAAAGSPVFLSALSPLGQQLLERFGWRGGFLLLGGLLLHCCACGAVMRPPPGPGPRPRRDSAGDRAGDAPGEAEADGAGLQLREASPRVRPRRRLLDLAVCTDRAFAVYAVTKFLMALGLFVPAILLVNYAKDAGVPDTDAAFLLSIVGFVDIVARPACGALAGLARLRPHVPYLFSLALLANGLTDLSSARARSYGALVAFCVAFGLSYGMVGALQFEVLMAAVGAPRFPSALGLVLLVEAAAVLIGPPSAGRLVDVLKNYEIIFYLAGSEVALAGVFMAVATNCCLRCAKAAPSGPGTEGGASDTEDAEAEGDSEPLPVVAEEPGNLEALEVLSARGEPTEPEIEARPRLAAESV

SEQ ID NO: 1368 - protein, 1118 aa, Homo sapiens
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKGLGGQQKGHTSPCGMKQRHEKGPPHQQEREVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLEDAEKEEEQSMLAMEDEGTVQLPLEGHYRDDPSVINISDEMSKTALWRNLLITADNSKDKESSFPSKSSPS

SEQ ID NO: 1369 - protein, 946 aa, Homo sapiens
MVPWVRTMGQKLKQRLRLDVGREICRQYPLFCFLLLCLSAASLLLNRYIHILMIFWSFVVGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVRFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 1370 - protein, 450 aa, Homo sapiens
MEQAPPDPERQLQPAPLEPLGSPDAGLGAAVGKEAEGAGEESSGVDTMTHNNFWLKKIEISVSEAEKRTGRNAMNMQETYTAYLIETRSVEHTDGQSVLTDSLWRRYSEFELLRSYLLVYYPHIVVPPLPEKRAEFVWHKLSADNMDPDFVERRRIGLENFLLRIASHPILCRDKIFYLFLTQEGNWKETVNETGFQLKADSRLKALNATFRVKNPDKRFTDLKHYSDELQSVISHLLRVRARVADRLYGVYKVHGNYGRVFSEWSAIEKEMGDGLQSAGHHMDVYASSIDDILEDEEHYADQLKEYLFYAEALRAVCRKHELMQYDLEMAAQDLASKKQQCEELVTGTVRTFSLKGMTTKLFGQETPEQREARIKVLEEQINEGEQQLKSKNLEGREFVKNAWADIERFKEQKNRDLKEALISYAVMQISMCKKGIQVWTNAKECFSKM

SEQ ID NO: 1371 - protein, 3674 aa, Homo sapiens
MAGQPHSPRELLGAAGHRSRRPSTELRVPPSPSLTMDSQYETGHIRKLQARHMQMQEKTFTKWINNVFQCGQAGIKIRNLYTELADGIHLLRLLELISGEALPPPSRGRLRVHFLENSSRALAFLRAKVPVPLIGPENIVDGDQTLILGLIWVIILRFQISHISLDKEEFGASAALLSTKEALLVWCQRKTASYTNVNITDFSRSWSDGLGFNALIHAHRPDLLDYGSLRPDRPLHNLAFAFLVAEQELGIAQLLDPEDVAAAQPDERSIMTYVSLYYHYCSRLHQGQTVQRRLTKILLQLQETELLQTQYEQLVADLLRWIAEKQMQLEARDFPDSLPAMRQLLAAFTIFRTQEKPPRLQQRGAAEALLFRLQTALQAQNRRPFLPHEGLGLAELSQCWAGLEWAEAARSQALQQRLLQLQRLETLARRFQRKAALRESFLKDAEQVLDQARAPPASLATVEAAVQRLGMLEAGILPQEGRFQALAEIADILRQEQYHSWADVARRQEEVTVRWQRLLQHLQGQRKQVADMQAVLSLLQEVEAASHQLEELQEPARSTACGQQLAEVVELLQRHDLLEAQVSAHGAHVSHLAQQTAELDSSLGTSVEVLQAKARTLAQLQQSLVALVRARRALLEQTLQRAEFLRNCEEEEAWLKECGQRVGNAALGRDLSQIAGALQKHKALEAEVHRHQAVCVDLVRRGRDLSARRPPTQPDPGERAEAVQGGWQLLQTRVVGRGARLQTALLVLQYFADAAEAASWLRERRSSLERASCGQDQAAAETLLRRHVRLERVLRAFAAELRRLEEQGRAASARASLFTVNSALSPPGESLRNPGPWSEASCHPGPGDAWKMALPAEPDPDFDPNTILQTQDHLSQDYESLRALAQLRRARLEEAMALFGFCSSCGELQLWLEKQTVLLQRVQPQADTLEVMQLKYENFLTALAVGKGLWAEVSSSAEQLRQRYPGNSTQIQRQQEELSQRWGQLEALKREKAVQLAHSVEVCSFLQECGPTQVQLRDVLLQLEALQPGSSEDTRHALQLAQKKTLVLERRVYFLQSVVVKVEEPGYAESQPLQGQVETLQGLLKQVQEQVAQRARRQAETQARQSFLQESQQLLLWAESVQAQLRSKEVSVDVASAQRLLREHQDLLEEIHLWQERLQQLDAQSQPMAALDCPDSQEVPNTLRVLGQQGQELKVLWEQRQQWLQEGLELQKFGREVDGFTATCANHQAWLHLDNLGEDVREALSLLQQHREFGRLLSTLGPRAEALRAHGEKLVQSQHPAAHTVREQLQSIQAQWTRLQGRSEQRRRQLLASLQLQEWKQDVAELMQWMEEKGLMAAHEPSGARRNILQTLKRHEAAESELLATRRHVEALQQVGRELLSRRPCGQEDIQTRLQGLRSKWEALNRKMTERGDELQQAGQQEQLLRQLQDAKEQLEQLEGALQSSETGQDLRSSQRLQKRHQQLESESRTLAAKMAALASMAHGMAASPAILEETQKHLRRLELLQGHLAIRGLQLQASVELHQFCHLSNMELSWVAEHMPHGSPTSYTECLNGAQSLHRKHKELQVEVKAHQGQVQRVLSSGRSLAASGHPQAQHIVEQCQELEGHWAELERACEARAQCLQQAVTFQQYFLDVSELEGWVEEKRPLVSSRDYGRDEAATLRLINKHQALQEELAIYWSSMEELDQTAQTLTGPEVPEQQRVVQERLREQLRALQELAATRDRELEGTLRLHEFLREAEDLQGWLASQKQAAKGGESLGEDPEHALHLCTKFAKFQHQVEMGSQRVAACRLLAESLLERGHSAGPMVRQRQQDLQTAWSELWELTQARGHALRDTETTLRVHRDLLEVLTQVQEKATSLPNNVARDLCGLEAQLRSHQGLERELVGTERQLQELLETAGRVQKLCPGPQAHAVQQRQQAVTQAWAVLQRRMEQRRAQLERARLLARFRTAVRDYASWAARVRQDLQVEESSQEPSSGPLKLSAHQWLRAELEAREKLWQQATQLGQQALLAAGTPTKEVQEELRALQDQRDQVYQTWARKQERLQAEQQEQLFLRECGRLEEILAAQEVSLKTSALGSSVEEVEQLIRKHEVFLKVLTAQDKKEAALRERLKTLRRPRVRDRLPILLQRRMRVKELAESRGHALHASLLMASFTQAATQAEDWIQAWAQQLKEPVPPGDLRDKLKPLLKHQAFEAEVQAHEEVMTSVAKKGEALLAQSHPRAGEVSQRLQGLRKHWEDLRQAMALRGQELEDRRNFLEFLQRVDLAEAWIQEKEVKMNVGDLGQDLEHCLQLRRRLREFRGNSAGDTVGDACIRSISDLSLQLKNRDPEEVKIICQRRSQLNNRWASFHGNLLRYQQQLEGALEIHVLSRELDNVTKRIQEKEALIQALDCGKDLESVQRLLRKHEELEREVHPIQAQVESLEREVGRLCQRSPEAAHGLRHRQQEVAESWWQLRSRAQKRREALDALHQAQKLQAMLQELLVSAQRLRAQMDTSPAPRSPVEARRMLEEHQECKAELDSWTDSISLARSTGQQLLTAGHPFSSDIRQVLAGLEQELSSLEGAWQEHQLQLQQALELQLFLSSVEKMERWLCSKEDSLASEGLWDPLAPMEPLLWKHKMLEWDLEVQAGKISALEATARGLHQGGHPEAQSALGRCQAMLLRKEALFRQAGTRRHRLEELRQLQAFLQDSQEVAAWLREKNLVALEEGLLDTAMLPAQLQKQQNFQAELDASMHQQQELQREGQRLLQGGHPASEAIQERLEELGALWGELQDNSQKKVAKLQKACEALRLRRSMEELENWLEPIEVELRAPTVGQALPGVGELLGTQRELEAAVDKKARQAEALLGQAQAFVREGHCLAQDVEEQARRLLQRFKSLREPLQERRTALEARSLLLKFFRDADEEMAWVQEKLPLAAAQDYGQSLSAVRHLQEQHQNLESEMSSHEALTRVVLGTGYKLVQAGHFAAHEVAARVQQLEKAMAHLRAEAARRRLLLQQAQEAQQFLTELLEAGSWLAERGHVLDSEDMGHSAEATQALLRRLEATKRDLEAFSPRIERLQQTAALLESRKNPESPKVLAQLQAVREAHAELLRRAEARGHGLQEQLQLHQLERETLLLDAWLTTKAATAESQDYGQDLEGVKVLEEKFDAFRKEVQSLGQAKVYALRKLAGTLERGAPRRYPHIQAQRSRIEAAWERLDQAIKARTENLAAAHEVHSFQQAAAELQGRMQEKTALMKGEDGGHSLSSVRTLQQQHRRLERELEAMEKEVARLQTEACRLGQLHPAAPGGLAKVQEAWATLQAKAQERGQWLAQAAQGHAFLGRCQELLAWAQERQELASSEELAEDVAGAEQLLGQHEELGQEIRECRLQAQDLRQEGQQLVDNSHFMSAEVTECLQELEGRLQELEEAWALRWQRCAESWGLQKLRQRLEQAEAWLACWEGLLLKPDYGHSVSDVELLLHRHQDLEKLLAAQEEKFAQMQKTEMEQELLLQPQELKPGRAGSSLTSFQWRPSGHQGLGAQLAETRDPQDAKGTPTMEGSLEFKQHLLPGGRQPSSSSWDSCRGTLQGSSLSLFLDERMAAEKVASIALLDLTGARCERLRGRHGRKHTFSLRLTSGAEILFAAPSEEQAESWWRALGSTAAQSLSPKLKAKPVSSLNECTTKDARPGCLLRSDP

SEQ ID NO: 1372 - protein, 599 aa, Homo sapiens
MDGSRRVRATSVLPRYGPPCLFKGHLSTKSNAFCTDSSSLRLSTLQLVKNHMAVHYNKILSAKAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 1373 - protein, 471 aa, Homo sapiens
MQSNKTFNLEKQNHTPRKHHQHHHQQQHHQQQQQQPPPPPIPANGQQASSQNEGLTIDLKNFRKPGEKTFTQRSRLFVGNLPPDITEEEMRKLFEKYGKAGEVFIHKDKGFGFIRLETRTLAEIAKVELDNMPLRGKQLRVRFACHSASLTVRNLPQYVSNELLEEAFSVFGQVERAVVIVDDRGRPSGKGIVEFSGKPAARKALDRCSEGSFLLTTFPRPVTVEPMDQLDDEEGLPEKLVIKNQQFHKEREQPPRFAQPGSFEYEYAMRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 1374 - protein, 1258 aa, Homo sapiens
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQSVVDDWIESYKQDRDIALLDLINFFIQCSGCRGTVRIEMFRNMQNAEIIRKMTEEFDEDSGDYPLTMPGPQWKKFRSNFCEFIGVLIRQCQYSIIYDEYMMDTVISLLTGLSDSQVRAFRHTSTLAAMKLMTALVNVALNLSIHQDNTQRQYEAERNKMIGKRANERLELLLQKRKELQENQDEIENMMNSIFKGIFVHRYRDAIAEIRAICIEEIGVWMKMYSDAFLNDSYLKYVGWTLHDRQGEVRLKCLKALQSLYTNRELFPKLELFTNRFKDRIVSMTLDKEYDVAVEAIRLVTLILHGSEEALSNEDCENVYHLVYSAHRPVAVAAGEFLHKKLFSRHDPQAEEALAKRRGRNSPNGNLIRMLVLFFLESELHEHAAYLVDSLWESSQELLKDWECMTELLLEEPVQGEEAMSDRQESALIELMVCTIRQAAEAHPPVGRGTGKRVLTAKERKTQIDDRNKLTEHFIITLPMLLSKYSADAEKVANLLQIPQYFDLEIYSTGRMEKHLDALLKQIKFVVEKHVESDVLEACSKTYSILCNEEYTIQNRVDIARSQLIDEFVDRFNHSVEDLLQEGEEADDDDIYNVLSTLKRLTSFQNAHDLTKWDLFGNCYRLLKTGIEHGAMPEQIVVQALQCSHYSILWQLVKITDGSPSKEDLLVLRKTVKSFLAVCQQCLSNVNTPVKEQAFMLLCDLLMIFSHQLMTGGREGLQPLVFNPDTGLQSELLSFVMDHVFIDQDEENQSMEGDEEDEANKIEALHKRRNLLAAFSKLIIYDIVDMHAAADIFKHYMKYYNDYGDIIKETLSKTRQIDKIQCAKTLILSLQQLFNELVQEQGPNLDRTSAHVSGIKELARRFALTFGLDQIKTREAVATLHKDGIEFAFKYQNQKGQEYPPPNLAFLEVLSEFSSKLLRQDKKTVHSYLEKFLTEQMMERREDVWLPLISYRNSLVTGGEDDRMSVNSGSSSSKTSSVRNKKGRPPLHKKRVEDESLDNTWLNRTDTMIQTPGPLPAPQLTSTVLRENSRPMGDQIQEPESEHGSEPDFLHNPQMQISWLGQPKLEDLNRKDRTGMNYMKVRTGVRHAVRGLMEEDAEPIFEDVMMSSRSQLEDMNEEFEDTMVIDLPPSRNRRERAELRPDFFDSAAIIEDDSGFGMPMF

SEQ ID NO: 1375 - protein, 1221 aa, Homo sapiens
MITSELPVLQDSTNETTAHSDAGSELEETEVKGKRKRGRPGRPPSTNKKPRKSPGEKSRIEAGIRGAGRGRANGHPQQNGEGEPVTLFEVVKLGKSAMQSVVDDWIESYKQDRDIALLDLINFFIQCSGCRGTVRIEMFRNMQNAEIIRKMTEEFDEDSGDYPLTMPGPQWKKFRSNFCEFIGVLIRQCQYSIIYDEYMMDTVISLLTGLSDSQVRAFRHTSTLAAMKLMTALVNVALNLSIHQDNTQRQYEAERNKMIGKRANERLELLLQKRKELQENQDEIENMMNSIFKGIFVHRYRDAIAEIRAICIEEIGVWMKMYSDAFLNDSYLKYVGWTLHDRQGEVRLKCLKALQSLYTNRELFPKLELFTNRFKDRIVSMTLDKEYDVAVEAIRLVTLILHGSEEALSNEDCENVYHLVYSAHRPVAVAAGEFLHKKLFSRHDPQAEEALAKRRGRNSPNGNLIRMLVLFFLESELHEHAAYLVDSLWESSQELLKDWECMTELLLEEPVQGEEAMSDRQESALIELMVCTIRQAAEAHPPVGRGTGKRVLTAKERKTQIDDRNKLTEHFIITLPMLLSKYSADAEKVANLLQIPQYFDLEIYSTGRMEKHLDALLKQIKFVVEKHVESDVLEACSKTYSILCSEEYTIQNRVDIARSQLIDEFVDRFNHSVEDLLQEGEEADDDDIYNVLSTLKRLTSFHNAHDLTKWDLFGNCYRLLKTGIEHGAMPEQIVVQALQCSHYSILWQLVKITDGSPSKEDLLVLRKTVKSFLAVCQQCLSNVNTPVKEQAFMLLCDLLMIFSHQLMTGGREGLQPLVFNPDTGLQSELLSFVMDHVFIDQDEENQSMEGDEEDEANKIEALHKRRNLLAAFSKLIIYDIVDMHAAADIFKHYMKYYNDYGDIIKETLSKTRQIDKIQCAKTLILSLQQLFNELVQEQGPNLDRTSAHVSGIKELARRFALTFGLDQIKTREAVATLHKDGIEFAFKYQNQKGQEYPPPNLAFLEVLSEFSSKLLRQDKKTVHSYLEKFLTEQMMERREDVWLPLISYRNSLVTGGEDDRMSVNSGSSSSKTSSVRNKKGRPPLHKKRVEDESLDNTWLNRTDTMIQTPGPLPAPQLTSTVLRENSRPMGDQIQEPESEHGSEPDFLHNRGLMEEDAEPIFEDVMMSSRSQLEDMNEEFEDTMVIDLPPSRNRRERAELRPDFFDSAAIIEDDSGFGMPMF

SEQ ID NO: 1376 - protein, 709 aa, Homo sapiens
MAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRSFDFEIETKQGTQYTFSSIEREEYGKLFDFVNAKKLNIKNRGLKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 1377 - protein, 543 aa, Homo sapiens
MEQSCEEEKEPEPQKNIQETKQVDDEDAELIFVGVEHVNEDAELIFVGVTSNSKPVVSNILNRVTPGSWSRRKKYDHLRKDTARKLQPKSHETVTSEAVTVLPASQLESRSTDSPIIIEPLSKPDYRNSSPQVVPNNSSELPSPLITFTDSLHHPVSTALSVGGINESPRVSKQLSTFEVNSINPKRAKLRDGIIEGNSSASFPSDTFHTMNTQQSTPSNNVHTSLSHVQNGAPFPAAFPKDNIHFKPINTNLDRANELAKTDILSLTSQNKTFDPKKENPIVLLSDFYYGQHKGEGQPEQKTHTTFKCLSCVKVLKNVKFMNHVKHHLEFEKQRNDSWENHTTCQHCHRQFPTPFQLQCHIENVHTAQEPSTVCKICELSFETDQVLLQHMKDHHKPGEMPYVCQVCHYRSSVFADVETHFRTCHENTKNLLCPFCLKIFKTATPYMCHYRGHWGKSAHQCSKCRLQFLTFKEKMEHKTQCHQMFKKPKQLEGLPPETKVTIQVSLEPLQPGSVDVASITVSTSDSEPSLPRSKSKISKKSH

SEQ ID NO: 1378 - protein, 1080 aa, Homo sapiens
MSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRF

SEQ ID NO: 1379 - protein, 229 aa, Homo sapiens
MEGASFGAGRAGAALDPVSFARRPQTLLRVASWVFSIAVFGPIVNEGYVNTDSGPELRCVFNGNAGACRFGVALGLGAFLACAAFLLLDVRFQQISSVRDRRRAVLLDLGFSGLWSFLWFVGFCFLTNQWQRTAPGPATTQAGDAARAAIAFSFFSILSWVALTVKALQRFRLGTDMSLFATEQLSTGASQAYPGYPVGSGVEGTETYQSPPFTETLDTSPKGYQVPAY

SEQ ID NO: 1380 - protein, 145 aa, Homo sapiens
MNGRVDYLVTEEEINLTRGPSGLGFNIVGGTDQQYVSNDSGIYVSRIKENGAAALDGRLQEGDKILSVNGQDLKNLLHQDAVDLFRNAGYAVSLRVQHRLQVQNGPIGHRGEGDPSGIPIFMVLVPVFALTMVAAWAFMRYRQQL

SEQ ID NO: 1381 - protein, 1563 aa, Homo sapiens [sequence omitted]

SEQ ID NO: 1382 - protein, 2541 aa, Homo sapiens
MVALSLKISIGNVVKTMQFEPSTMVYDACRIIRERIPEAPAGPPSDFGLFLSDDDPKKGIWLEAGKALDYYMLRNGDTMEYRKKQRPLKIRMLDGTVKTIMVDDSKTVTDMLMTICARIGITNHDEYSLVRELMEEKKEEITGTLRKDKTLLRDEKKMEKLKQKLHTDDELNWLDHGRTLREQGVEEHETLLLRRKFFYSDQNVDSRDPVQLNLLYVQARDDILNGSHPVSFDKACEFAGFQCQIQFGPHNEQKHKAGFLDLKDFLPKEYVKQKGERKIFQAHKNCGQMSEIEAKVRYVKLARSLKTYGVSFFLVKEKMKGKNKLVPRLLGITKECVMRVDEKTKEVIQEWNLTNIKRWAASPKSFTLDFGDYQDGYYSVQTTEGEQIAQLIAGYIDIILKKKKSKDHFGLEGDEESTMLEDSVSPKKSTVLQQQYNRVGKVEHGSVALPAIMRSGASGPENFQVGSMPPAQQQITSGQMHRGHMPPLTSAQQALTGTINSSMQAVQAAQATLDDFDTLPPLGQDAASKAWRKNKMDESKHEIHSQVDAITAGTASVVNLTAGDPAETDYTAVGCAVTTISSNLTEMSRGVKLLAALLEDEGGSGRPLLQAAKGLAGAVSELLRSAQPASAEPRQNLLQAAGNVGQASGELLQQIGESDTDPHFQDALMQLAKAVASAAAALVLKAKSVAQRTEDSGLQTQVIAAATQCALSTSQLVACTKVVAPTISSPVCQEQLVEAGRLVAKAVEGCVSASQAATEDGQLLRGVGAAATAVTQALNELLQHVKAHATGAGPAGRYDQATDTILTVTENIFSSMGDAGEMVRQARILAQATSDLVNAIKADAEGESDLENSRKLLSAAKILADATAKMVEAAKGAAAHPDSEEQQQRLREAAEGLRMATNAAAQNAIKKKLVQRLEHAAKQAAASATQTIAAAQHAASTPKASAGPQPLLVQSCKAVAEQIPLLVQGVRGSQAQPDSPSAQLALIAASQSFLQPGGKMVAAAKASVPTIQDQASAMQLSQCAKNLGTALAELRTAAQKAQEACGPLEMDSALSVVQNLEKDLQEVKAAARDGKLKPLPGETMEKCTQDLGNSTKAVSSAIAQLLGEVAQGNENYAGIAARDVAGGLRSLAQAARGVAALTSDPAVQAIVLDTASDVLDKASSLIEEAKKAAGHPGDPESQQRLAQVAKAVTQALNRCVSCLPGQRDVDNALRAVGDASKRLLSDSLPPSTGTFQEAQSRLNEAAAGLNQAATELVQASRGTPQDLARASGRFGQDFSTFLEAGVEMAGQAPSQEDRAQVVSNLKGISMSSSKLLLAAKALSTDPAAPNLKSQLAAAARAVTDSINQLITMCTQQAPGQKECDNALRELETVRELLENPVQPINDMSYFGCLDSVMENSKVLGEAMTGISQNAKNGNLPEFGDAISTASKALCGFTEAAAQAAYLVGVSDPNSQAGQQGLVEPTQFARANQAIQMACQSLGEPGCTQAQVLSAATIVAKHTSALCNSCRLASARTTNPTAKRQFVQSAKEVANSTANLVKTIKALDGAFTEENRAQCRAATAPLLEAVDNLSAFASNPEFSSIPAQISPEGRAAMEPIVISAKTMLESAGGLIQTARALAVNPRDPPSWSVLAGHSRTVSDSIKKLITSMRDKAPGQLECETAIAALNSCLRDLDQASLAAVSQQLAPREGISQEALHTQMLTAVQEISHLIEPLANAARAEASQLGHKVSQMAQYFEPLTLAAVGAASKTLSHPQQMALLDQTKTLAESALQLLYTAKEAGGNPKQAAHTQEALEEAVQMMTEAVEDLTTTLNEAASAAGVVGGMVDSITQAINQLDEGPMGEPEGSFVDYQTTMVRTAKAIAVTVQEMVTKSNTSPEELGPLANQLTSDYGRLASEAKPAAVAAENEEIGSHIKHRVQELGHGCAALVTKAGALQCSPSDAYTKKELIECARRVSEKVSHVLAALQAGNRGTQACITAASAVSGIIADLDTTIMFATAGTLNREGTETFADHREGILKTAKVLVEDTKVLVQNAAGSQEKLAQAAQSSVATITRLADVVKLGAASLGAEDPETQVVLINAVKDVAKALGDLISATKAAAGKVGDDPAVWQLKNSAKVMVTNVTSLLKTVKAVEDEATKGTRALEATTEHIRQELAVFCSPEPPAKTSTPEDFIRMTKGITMATAKAVAAGNSCRQEDVIATANLSRRAIADMLRACKEAAYHPEVAPDVRLRALHYGRECANGYLELLDHVLLTLQKPSPELKQQLTGHSKRVAGSVTELIQAAEAMKGTEWVDPEDPTVIAENELLGAAAAIEAAAKKLEQLKPRAKPKEADESLNFEEQILEAAKSIAAATSALVKAASAAQRELVAQGKVGAIPANALDDGQWSQGLISAARMVAAATNNLCEAANAAVQGHASQEKLISSAKQVAASTAQLLVACKVKADQDSEAMKRLQAAGNAVKRASDNLVKAAQKAAAFEEQENETVVVKEKMVGGIAQIIAAQEEMLRKERELEEARKKLAQIRQQQYKFLPSELRDEH

SEQ ID NO: 1383 - protein, 1621 aa, Homo sapiens
MEWVLAEALLSQSRDPRALLGALCQGEASAERVETLRFLLQRLEDEEARGSGGAGALPEAAREVAAGYLVPLLRSLRGRPAGGPDPSLQPRHRRRVLRAAGAALRSCVRLAGRPQLAAALAEEALRDLLAGWRAPGAEAAVEVLAAVGPCLRPREDGPLLERVAGTAVALALGGGGDGDEAGPAEDAAALVAGRLLPVLVQCGGAALRAVWGGLAAPGASLGSGRVEEKLLVLSALAEKLLPEPGGDRARGAREAGPDARRCWRFWRTVQAGLGQADALTRKRARYLLQRAVEVSAELGADCTCGPQEGNGPSLFWWSERKKDELLKFWENYILIMETLEGNQIHVIKPVLPKLNNLFEYAVSEENGCWLFHPSWHMCIYKRMFESENKILSKEGVIHFLELYETKILPFSPEFSEFIIGPLMDALSESSLYSRSPGQPIGSCSPLGLKLQKFLVTYISLLPEEIKSSFLLKFIRKMTSRHWCAVPILFLSKALANVPRHKALGIDGLLALRDVIHCTMITHQILLRGAAQCYLLQTAMNLLDVEKVSLSDVSTFLMSLRQEESLGRGTSLWTELCDWLRVNESYFKPSPTCSSIGLHKTSLNAYVKSIVQEYVKSSAWETGENCFMPDWFEAKLVSLMVLLAVDVEGMKTQYSGKQRTENVLRIFLDPLLDVLMKFSTNAYMPLLKTDRCLQLLLKLLNTCRLKGSSAQDDEVSTVLQNFFMSTTESISEFILRRLTMNELNSVSDLDRCHLYLMVLTELINLHLKVGWKRGNPIWRVISLLKNASIQHLQEMDSGQEPTVGSQIQRVVSMAALAMVCEAIDQKPELQLDSLHAGPLESFLSSLQLNQTLQKPHAEEQSSYAHPLECSSVLEESSSSQGWGKIVAQYIHDQWVCLSFLLKKYHTLIPTTGSEILEPFLPAVQMPIRTLQSALEALTVLSSDQVLPVFHCLKVLVPKLLTSSESLCIESFDMAWKIISSLSNTQLIFWANLKAFVQFVFDNKVLTIAAKIKGQAYFKIKEIMYKIIEMSAIKTGVFNTLISYCCQSWIVSASNVSQGSLSSAKNYSELILEACIFGTVFRRDQRLVQDVQTFIENLGHDCAANIVMENTKREDHYVRICAVKFLCLLDGSNMSHKLFIEDLAIKLLDKDELVSKSKKRYYVNSLQHRVKNRVWQTLLVLFPRLDQNFLNGIIDRIFQAGFTNNQASIKYFIEWIIILILHKFPQFLPKFWDCFSYGEENLKTSICTFLAVLSHLDIITQNIPEKKLILKQALIVVLQWCFNHNFSVRLYALVALKKLWTVCKVLSVEEFDALTPVIESSLHQVESMHGAGNAKKNWQRIQEHFFFATFHPLKDYCLETIFYILPRLSGLIEDEWITIDKFTRFTDVPLAAGFQWYLSQTQLSKLKPGDWSQQDIGTNLVEADNQAEWTDVQKKIIPWNSRVSDLDLELLFQDRAARLGKSISRLIVVASLIDKPTNLGGLCRTCEVFGASVLVVGSLQCISDKQFQHLSVSAEQWLPLVEVKPPQLIDYLQQKKTEGYTIIGVEQTAKSLDLTQYCFPEKSLLLLGNEREGIPANLIQQLDVCVEIPQQGIIRSLNVHVSGALLIWEYTRQQLLSHGDTKP

SEQ ID NO: 1384 - protein, 315 aa, Homo sapiens
MGLTEGVFLILSGTQFTLGILVNCFIELVNGSSWFKTKRMSLSDFIITTLALLRIILLCIILTDSFLIEFSPNTHDSGIIMQIIDVSWTFTNHLSIWLATCLGVLYCLKIASFSHPTFLWLKWRVSRVMVWMLLGALLLSCGSTASLINEFKLYSVFRGIEATRNVTEHFRKKRSEYYLIHVLGTLWYLPPLIVSLASYSLLIFSLGRHTRQMLQNGTSSRDPTTEAHKRAIRIILSFFFLFLLYFLAFLIASFGNFLPKTKMAKMIGEVMTMFYPAGHSFILILGNSKLKQTFVVMLRCESGHLKPGSKGPIFS

SEQ ID NO: 1385 - protein, 323 aa, Homo sapiens
MATVNTDATDKDISKFKVTFTLVVSGIECITGILGSGFITAIYGAEWARGKTLPTGDRIMLMLSFSRLLLQIWMMLENIFSLLFRIVYNQNSVYILFKVITVFLNHSNLWFAAWLKVFYCLRIANFNHPLFFLMKRKIIVLMPWLLRLSVLVSLSFSFPLSRDVFNVYVNSSIPIPSSNSTEKKYFSETNMVNLVFFYNMGIFVPLIMFILAATLLILSLKRHTLHMGSNATGSRDPSMKAHIGAIKATSYFLILYIFNAIALFLSTSNIFDTYSSWNILCKIIMAAYPAGHSVQLILGNPGLRRAWKRFQHQVPLYLKGQTL

SEQ ID NO: 1386 - protein, 242 aa, Homo sapiens
MAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAEGFVRVDRDYVLKSAELAKAGGCKHFNLLSSKGADKSSNFLYLQVKGEVEAKVEELKFDRYSVFRPGVLLCDRQESRPGEWLVRKFFGSLPDSWARGHSVPVVTVVRAMLNNVVRPRDKQMELLENKAIHDLGKAHGSLKP

SEQ ID NO: 1387 - protein, 677 aa, Homo sapiens
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAHWLSIEGCQPAIPENPPPAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPGLYQMLPRFSTFISEGVRVNVVQNNLALLIYLMRMVKALMDNPTLYLEKYVHELIPAVMTCIVSRQLCLRPDVDNHWALRDFAARLVAQICKHFSTTTNNIQSRITKTFTKSWVDEKTPWTTRYGSIAGLAELGHDVIKTLILPRLQQEGERIRSVLDGPVLSNIDRIGADHVQSLLLKHCAPVLAKLRPPPDNQDAYRAEFGSLGPLLCSQVVKARAQAALQAQQVNRTTLTITQPRPTLTLSQAPQPGPRTPGLLKVPGSIALPVQTLVSARAAAPPQPSPPPTKFIVMSSSSSAPSTQQVLSLSTSAPGSGSTTTSPVTTTVPSVQPIVKLVSTATTAPPSTAPSGPGSVQKYIVVSLPPTGEGKGGPTSHPSPVPPPASSPSPLSGSALCGGKQEAGDSPPPAPGTPKANGSQPNSGSPQPAP

SEQ ID NO: 1388 - protein, 266 aa, Homo sapiens [sequence omitted]

SEQ ID NO: 1389 - protein, 534 aa, Homo sapiens
ASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLIAKKIHPQTIIAGWREATKAAREALLSSAVDHGSDEVKFRQDLMNIAGTTLSSKLLTHHKDHFTKLAVEAVLRLKGSGNLEAIHIIKKLGGSLADSYLDEGFLLDKKIGVNQPKRIENAKILIANTGMDTDKIKIFGSRVRVDSTAKVAEIEHAEKEKMKEKVERILKHGINCFINRQLIYNYPEQLFGAAGVMAIEHADFAGVERLALVTGGEIASTFDHPELVKLGSCKLIEEVMIGEDKLIHFSGVALGEACTIVLRGATQQILDEAERSLHDALCVLAQTVKDSRTVYGGGCSEMLMAHAVTQLANRTPGKEAVAMESYAKALRMLPTIIADNAGYDSADLVAQLRAAHSEGNTTAGLDMREGTIGDMAILGITESFQVKRQVLLSAAEAAEVILRVDNIIKAAPRKRVPDHHPC

SEQ ID NO: 1390 - protein, 1419 aa, Homo sapiens
MAEGLERVRISASELRGILATLAPQAGSRENMKELKEARPRKDNRRPDLEIYKPGLSRLRNKPKIKEPPGSEEFKDEIVNDRDCSAVENGTQPVKDVCKELNNQEQNGPIDPENNRGQESFPRTAGQEDRSLKIIKRTKKPDLQIYQPGRRLQTVSKESASRVEEEEVLNQVEQLRVEEDECRGNVAKEEVANKPDRAEIEKSPGGGRVGAAKGEKGKRMGKGEGVRETHDDPARGRPGSAKRYSRSDKRRNRYRTRSTSSAGSNNSAEGAGLTDNGCRRRRQDRTKERPRLKKQVSVSSTDSLDEDRIDEPDGLGPRRSSERKRHLERNWSGRGEGEQKNSAKEYRGTLRVTFDAEAMNKESPMVRSARDDMDRGKPDKGLSSGGKGSEKQESKNPKQELRGRGRGILILPAHTTLSVNSAGSPESAPLGPRLLFGSGSKGSRSWGRGGTTRRLWDPNNPDQKPALKTQTPQLHFLDTDDEVSPTSWGDSRQAQASYYKFQNSDNPYYYPRTPGPASQYPYTGYNPLQYPVGPTNGVYPGPYYPGYPTPSGQYVCSPLPTSTMSPEEVEQHMRNLQQQELHRLLRVADNQELQLSNLLSRDRISPEGLEKMAQLRAELLQLYERCILLDIEFSDNQNVDQILWKNAFYQVIEKFRQLVKDPNVENPEQIRNRLLELLDEGSDFFDSLLQKLQVTYKFKLEDYMDGLAIRSKPLRKTVKYALISAQRCMICQGDIARYREQASDTANYGKARSWYLKAQHIAPKNGRPYNQLALLAVYTRRKLDAVYYYMRSLAASNPILTAKESLMSLFEETKRKAEQMEKKQHEEFDLSPDQWRKGKKSTFRHVGDDTTRLEIWIHPSHPRSSQGTESGKDSEQENGLGSLSPSDLNKRFILSFLHAHGKLFTRIGMETFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 1391 - protein, 1205 aa, Homo sapiens
MVKCYHKKYRSATRDVIFRLQFHTGAVQGYGLVFGKEDLDNASKDDRFPDYGKVELVFSATPEKIQGSEHLYNDHGVIVDYNTTDPLIRWDSYENLSADGEVLHTQGPVDGSLYAKVRKKSSSDPGIPGGPQAIPATNSPDHSDHTLSVSSDSGHSTASARTDKTEERLAPGTRRGLSAQEKAELDQLLSGFGLEDPGSSLKEMTDARSKYSGTRHVVPAQVHVNGDAALKDRETDILDDEMPHHDLHSVDSLGTLSSSEGPQSAHLGPFTCHKSSQNSLLSDGFGSNVGEDPQGTLVPDLGLGMDGPYERERTFGSREPKQPQPLLRKPSVSAQMQAYGQSSYSTQTWVRQQQMVVAHQYSFAPDGEARLVSRCPADNPGLVQAQPRVPLTPTRGTSSRVAVQRGVGSGPHPPDTQQPSPSKAFKPRFPGDQVVNGAGPELSTGPSPGSPTLDIDQSIEQLNRLILELDPTFEPIPTHMNALGSQANGSVSPDSVGGGLRASSRLPDTGEGPSRATGRQGSSAEQPLGGRLRKLSLGQYDNDAGGQLPFSKCAWGKAGVDYAPNLPPFPSPADVKETMTPGYPQDLDIIDGRILSSKESMCSTPAFPVSPETPYVKTALRHPPFSPPEPPLSSPASQHKGGREPRSCPETLTHAVGMSESPIGPKSTMLRADASSTPSFQQAFASSCTISSNGPGQRRESSSSAERQWVESSPKPMVSLLGSGRPTGSPLSAEFSGTRKDSPVLSCFPPSELQAPFHSHELSLAEPPDSLAPPSSQAFLGFGTAPVGSGLPPEEDLGALLANSHGASPTPSIPLTATGAADNGFLSHNFLTVAPGHSSHHSPGLQGQGVTLPGQPPLPEKKRASEGDRSLGSVSPSSSGFSSPHSGSTISIPFPNVLPDFSKASEAASPLPDSPGDKLVIVKFVQDTSKFWYKADISREQAIAMLKDKEPGSFIVRDSHSFRGAYGLAMKVATPPPSVLQLNKKAGDLANELVRHFLIECTPKGVRLKGCSNEPYFGSLTALVCQHSITPLALPCKLLIPERDPLEEIAESSPQTAANSAAELLKQGAACNVWYLNSVEMESLTGHQAIQKALSITLVQEPPPVSTVVHFKVSAQGITLTDNQRKLFFRRHYPVNSVIFCALDPQDRKWIKDGPSSKVFGFVARKQGSATDNVCHLFAEHDPEQPASAIVNFVSKVMIGSPKKV

SEQ ID NO: 1392 - protein, 1574 aa, Homo sapiens
PHEELPSLQRPRYGSIVDDERLSAEEMDERRRQNIAYEYLCHLEEAKRWMEVCLVEELPPTTELEEGLRNGVYLAKLAKFFAPKMVSEKKIYDVEQTRYKKSGLHFRHTDNTVQWLRAMESIGLPKIFYPETTDVYDRKNIPRMIYCIHALSLYLFKLGIAPQIQDLLGKVDFTEEEISNMRKELEKYGIQMPSFSKIGGILANELSVDEAALHAAVIAINEAVEKGIAEQTVVTLRNPNAVLTLVDDNLAPEYQKELWDAKKKKEENARLKNSCISEEERDAYEELLTQAEIQGNINKVNRQAAVDHINAVIPEGDPENTLLALKKPEAQLPAVYPFAAAMYQNELFNLQKQNTMNYLAHEELLIAVEMLSAVALLNQALESNDLVSVQNQLRSPAIGLNNLDKAYVERYANTLLSVKLEVLSQGQDNLSWNEIQNCIDMVNAQIQEENDRVVAVGYINEAIDEGNPLRTLETLLLPTANISDVDPAHAQHYQDVLYHAKSQKLGDSESVSKVLWLDEIQQAVDEANVDEDRAKQWVTLVVDVNQCLEGKKSSDILSVLKSSTSNANDIIPECADKYYDALVKAKELKSERVSSDGSWLKLNLHKKYDYYYNTDSKESSWVTPESCFYKESWLTGKEIEDIIEEVTVGYIRENIWSASEELLLRFQATSSGPILREEFEARKSFLHEQEENVVKIQAFWKGYKQRKEYMHRRQTFIDNTDSVVKIQSWFRMATARKSYLSRLQYFRDHNNEIVKIQSLLRANKARDDYKTLVGSENPPLTVIRKFVYLLDQSDLDFQEELEVARLREEVVTKIRANQQLEKDLNLMDIKIGLLVKNRITLEDVISHSKKLNKKKGGEMEILNNTDNQGIKSLSKERRKTLETYQQLFYLLQTNPLYLAKLIFQMPQNKSTKFMDTVIFTLYNYASNQREEYLLLKLFKTALEEEIKSKVDQVQDIVTGNPTVIKMVVSFNRGARGQNTLRQLLAPVVKEIIDDKSLIINTNPVEVYKAWVNQLETQTGEASKLPYDVTTEQALTYPEVKNKLEASIENLRRVTDKVLNSIISSLDLLPYGLRYIAKVLKNSIHEKFPDATEDELLKIVGNLLYYRYMNPAIVAPDGFDIIDMTAGGQINSDQRRNLGSVAKVLQHAASNKLFEGENEHLSSMNNYLSETYQEFRKYFKEACNVPEPEEKFNMDKYTDLVTVSKPVIYISIEEIISTHSLLLEHQDAIAPEKNDLLSELLGSLGEVPTVESFLGEGAVDPNDPNKANTLSQLSKTEISLVLTSKYDIEDGEAIDSRSLMIKTKKLIIDVIRNQPGNTLTEILETPATAQQEVDHATDMVSRAMIDSRTPEEMKHSQSMIEDAQLPLEQKKRKIQRNLRTLEQTGHVSSENKYQDILNEIAKDIRNQRIYRKLRKAELAKLQQTLNALNKKAAFYEEQINYYDTYIKTCLDNLKRKNTRRSIKLDGKGEPKGAKRAKPVKYTAAKLHEKGVLLDIDDLQTNQFKNVTFDIIATEDVGIFDVRSKFLGVEMEKVQLNIQDLLQMQYEGVAVMKMFDKVKVNVNLLIYLLNKKFYGK

SEQ ID NO: 1393 - protein, 735 aa, Homo sapiens
MEDAGGGEETPAPEAPHPPQLAPPEEQGLLFQEETIDLGGDEFGSEENETASEGSSPLADKLNEHMMESVLISDSPNSEGDAGDLGRVRDEAEPGGEGDPGPEPAGTPSPSGEADGDCAPEDAAPSSGGAPRQDAAREVPGSEAARPEQEPPVAEPVPVCTIFSQRAPPASGDGFEPQMVKSPSFGGASEASARTPPQVVQPSPSLSTFFGDTAASHSLASDFFDSFTTSAFISVSNPGAGSPAPASPPPLAVPGTEGRPEPVAMRGPQAAAPPASPEPFAHIQAVFAGSDDPFATALSMSEMDRRNDAWLPGEATRGVLRAVATQQRGAVFVDKENLTMPGLRFDNIQGDAVKDLMLRFLGEKAAAKRQVLNADSVEQSFVGLKQLISCRNWRAAVDLCGRLLTAHGQGYGKSGLLTSHTTDSLQLWFVRLALLVKLGLFQNAEMEFEPFGNLDQPDLYYEYYPHVYPGRRGSMVPFSMRILHAELQQYLGNPQESLDRLHKVKTVCSKILANLEQGLAEDGGMSSVTQEGRQASIRLWRSRLGRVMYSMANCLLLMKDYVLAVDAYHSVIKYYPEQEPQLLSGIGRISLQIGDIKTAEKYFQDVEKVTQKLDGLQGKIMVLMNSAFLHLGQNNFAEAHRFFTEILRMDPRNAVANNNAAVCLLYLGKLKDSLRQLEAMVQQDPRHYLHESVLFNLTTMYELESSRSMQKKQALLEAVAGKEGDSFNTQCLKLA

SEQ ID NO: 1394 - protein, 2054 aa, Homo sapiens
MFNLMKKDKDKDGGRKEKKEKKEKKERMSAAELRSLEEMSLRRGFFNLNRSSKRESKTRLEISNPIPIKVASGSDLHLTDIDSDSNRGSVILDSGHLSTASSSDDLKGEEGSFRGSVLQRAAKFGSLAKQNSQMIVKRFSFSQRSRDESASETSTPSEHSAAPSPQVEVRTLEGQLVQHPGPGIPRPGHRSRAPELVTKKFPVDLRLPPVVPLPPPTLRELELQRRPTGDFGFSLRRTTMLDRGPEGQACRRVVHFAEPGAGTKDLALGLVPGDRLVEINGHNVESKSRDEIVEMIRQSGDSVRLKVQPIPELSELSRSWLRSGEGPRREPSDAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSLQDMVTKYQKRKNKLEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 1395 - protein, 4074 aa, Homo sapiens
MTAWLISLMSIEVLLLAVRHLSLHIEPEEGSLAGGTWITVIFDGLELGVLYPNNGSQLEIHLVNVNMVVPALRSVPCDVFPVFLDLPVVTCRTRSVLSEAHEGLYFLEAYFGGQLVSSPNPGPRDSCTFKFSKAQTPIVHQVYPPSGVPGKLIHVYGWIITGRLETFDFDAEYIDSPVILEAQGDKWVTPCSLINRQMGSCYPIQEDHGLGTLQCHVEGDYIGSQNVSFSVFNKGKSMVHKKAWLISAKQDLFLYQTHSEILSVFPETGSLGGRTNITITGDFFDNSAQVTIAGIPCDIRHVSPRKIECTTRAPGKDVRLTTPQPGNRGLLFEVGDAVEGLELTEATPGYRWQIVPNASSPFGFWSQEGQPFRARLSGFFVAPETNNYTFWIQADSQASLHFSWSEEPRTKVKVASISVGTADWFDSWEQNRDEGTWQQKTPKLELLGGAMYYLEAEHHGIAPSRGMRIGVQIHNTWLNPDVVTTYLREKHQIRVRAQRLPEVQVLNVSGRGNFFLTWDNVSSQPIPANATAHLIQTTIEELLAVKCKLEPLWSNILLRLGFERGPEVSNSDGDLTSGTEPFCGRFSLRQPRHLVLTPPAAQKGYRLDQYTHLCLAYKGHMNKILKMIVSFTIGFQNMVKNTTCDWSLTRTSPESWQFDCTDLWETCVRCFGDLQPPPANSPVLVHQINLLPLAQETGLFYVDEIIIADTNVTVSQADSGTARPGGNLVESVSVVGSPPVYSVTSWLAGCGTELPLITARSVPTEGTEEGSGLVLVTTQRRQRTSPPLGGHFRIQLPNTVISDVPVQISAHHLHQLLQNNADDFTSRYLNASDFTVKEDLYTCYEHVWTLSWSTQIGDLPNFIRVSDENLTGVNPAAATRVVYDGGVFLGPIFGDMLATANQHTQVVVRVNDVPAHCPGSCSFQYLQGSTPCVHSVWYSIDGDINLMIYITGTGFSGDSQFLQVTVNKTSCKVIFSNQTNVVCQTDLLPVGMHRILMLVRPSGLAISATGEDLFLNVKPRLDMVEPSRAADIGGLWATIRGSSLEGVSLILFGSYSCAINVATSNSSRIQCKVPPRGKDGRIVNVTVIRGDYSAVLPRAFTYVSSLNPVIVTLSRNISNIAGGETLVIGVARLMNYTDLDVEVHVQDALAPVHTQSAWGLEVALPPLPAGLHRISVSINGVSIHSQGVDLHIQYLTEVFSIEPCCGSLLGGTILSISGIGFSRDPALVWVLVGNRSCDIVNLTEASIWCETLPAPQIPDAGAPTVPAAVEVWAGNRFFARGPSPSLVGKGFTFMYEAAATPVVTAMQGEITNSSLSLHVGGSNLSNSVILLGNLNCDVETQSFQGNVSLSGCSIPLHSLEAGIYPLQVRQKQMGFANMSVVLQQFAVMPRIMAIFPSQGSACGGTILTVRGLLLNSRRRSVRVDLSGPFTCVILSLGDHTILCQVSLEGDPLPGASFSLNVTVLVNGLTSECQGNCTLFIREEASPVMDALSTNTSGSLTTVLIRGQRLATTADEPMVFVDDQLPCNVTFFNASHVVCQTRDLAPGPHYLSVFYTRNGYACSGNVSRHFYIMPQVFHYFPKNFSLHGGSLLTIEGTGLRGQNTTSVYIDQQTCLTVNIGAELIRCIVPTGNGSVALEIEVDGLWYHIGVIGYNKAFTPELISISQSDDILTFAVAQISGAANIDIFIGMSPCVGVSGNHTVLQCVVPSLPAGEYHVRGYDCIRGWASSALVFTSRVIITAVTENFGCLGGRLVHVFGAGFSPGNVSAAVCGAPCRVLANATVSAFSCLVLPLDVSLAFLCGLKREEDSCEAARHTYVQCDLTVAMATEQLLESWPYLYICEESSQCLFVPDHWAESMFPSFSGLFISPKLERDEVLIYNSSCNITMETEAEMECETPNQPITVKITEIRKRWGQNTQGNFSLQFCRRWSRTHSWFPERLPQDGDNVTVENGQLLLLDTNTSILNLLHIKGGKLIFMAPGPIELRAHAILVSDGGELRIGSEDKPFQGRAQITLYGSSYSTPFFPYGVKFLAVRNGTLSLHGSLPEVIVTCLRATAHALDTVLALEDAVDWNPGDEVVIISGTGVKGAKPMEEIVTVETVQDTDLYLKSPLRYSHNFTENWVAGEHHILKATVALLSRSITIQGNLTNEREKLLVSCQEANAPEGNLQHCLYSMSEKMLGSRDMGARVIVQSFPEEPSQVQLKGVQFQVLGQAFHKHLSSLTLVGAMRESFIQGCTVRNSFSRGLSMCGTLGLKVDSNVFYNILGHALLVGTCTEMRYISWEAIHGRKDDWSGHGNIIRNNVIIQVSGAEGLSNPEMLTPSGIYICSPTNVIEGNRVCGAGYGYFFHLMTNQTSQAPLLSFTQNIAHSCTRYGLFVYPKFQPPWDNVTGTTLFQSFTVWESAGGAQIFRSSNLRLKNFKVYSCRDFGIDVLESDANTSVTDSLLLGHFAHKGSLCMSSGIKTPKRWELMVSNTTFVNFDLINCVAIRTCSDCSQGQGGFTVKTSQLKFTNSSNLVAFPFPHAAILEDLDGSLSGKNRSHILASMETLSASCLVNSSFGRVVHGSACGGGVLFHRMSIGLANTPEVSYDLTMTDSRNKTTTVNYVRDTLSNPRGWMALLLDQETYSLQSENLWINRSLQYSATFDNFAPGNYLLLVHTDLPPYPDILLRCGSRVGLSFPFLPSPGQNQGCDWFFNSQLRQLTYLVSGEGQVQVILRVKEGMPPTISASTSAPESALKWSLPETWQGVEEGWGGYNNTIPGPGDDVLILPNRTVLVDTDLPFFKGLYVMGTLDFPVDRSNVLSVACMVIAGGELKVGTLENPLEKEQKLLILLRASEGVFCDRMNGIHIDPGTIGVYGKVHLYSAYPKNSWTHLGADIASGNERIIVEDAVDWRPHDKIVLSSSSYEPHEAEVLTVKEVKGHHVRIYERLKHRHIGSVHVTEDGRHIRLAAEVGLLTRNIQIQPDVSCRGRLFVGSFRKSSREEFSGVLQLLNVEIQNFGSPLYSSVEFSNVSAGSWIISSTLHQSCGGGIHAAASHGVLLNDNIVFGTAGHGIDLEGQAYTVTNNLVVLMTQPAWSTIWVAGIKVNQVKDINLHGNVVAGSERLGFHIRGHKCSSCELLWSDNVAHSSLHGLHLYKESGLDNCTRISGFLAFKNFDYGAMLHVENSVEIENITLVDNTIGLLAVVYVFSAPQNSVKKVQIVLRNSVIVATSSSFDCIQDKVKPHSANLTSTDRAPSNPRGGRIGILWPVFTSEPNQWPQEPWHKVRNDHSISGIMKLQDVTFSSFVKSCYSDDLDVCILPNAENSGIMHPITAERTRMLKIKDKNKFYFPSLQPRKDLGKVVCPELDCASPRKYLFKDLDGRALGLPPPVSVFPKTEAEWTASFFNAGTFREEQKCTYQFLMQGFICKQTDQVVLILDSADAIWAIQKLYPVVSVTSGFVDVFSSVNANIPCSTSGSVSTFYSILPIRQITKVCFMDQTPQVLRFFLLGNKSTSKLLLAVFYHELQSPHVFLGESFIPPTLVQSASLLLNESIGANYFNIMDNLLYVVLQGEEPIEIRSGVSIHLALTVMVSVLEKGWEIVILERLTNFLQIGQNQIRFIHEMPGHEETLKAIADSRAKRKRNCPTVTCTSHYRRVGQRRPLMMEMNSHRASPPMTVETISKVIVIEIGDSPTVRSTGMISSLSSNKLQNLAHRVITAQQTGVLENVLNMTIGALLVTQSKGVIGYGNTSSFKTGNLIYIRPYALSILVQPSDGEVGNELPVQPQLVFLDEQNRRVESLGPPSEPWTISASLEGASDSVLKGCTQAETQDGYVSFYNLAVLISGSNWHFIFTVTSPPGVNFTARSKPFAVLPVTRKEKSTIILAASLSSVASWLALSCLVCCWLKRSKSRKTKPEEIPESQTNNQNIHIHISSKRRESQGPKKEDTVVGEDMRMKVMLGKVNQCPHQLMNGVSRRKVSRHIVREEEAAVPAPGTTGITSHGHICAPGAPAQQVYLQETGNWKEGQEQLLRYQLAGQNQLLLLCPDFRQERQQLPGQSRLSKQSGSLGLSQEKKASCGATEAFCLHSVHPETIQEQL

SEQ ID NO: 1396 - protein, 706 aa, Homo sapiens [sequence omitted]

SEQ ID NO: 1397 - protein, 190 aa, Homo sapiens
MAVATDVFNSKNLAVQAQKKILGKMVSKSIATTLIDDTSSEVLDELYRVTREYTQNKKEAEKIIKNLIKTVIKLAILYRNNQFNQDELALMEKFKKKVHQLAMTVVSFHQVDYTFDRNVLSRLLNECREMLHQIIQRHLTAKSHGRVNNVFDHFSDCEFLAALYNPFGNFKPHLQKLCDGINKMLDEENI

SEQ ID NO: 1398 - protein, 1041 aa, Homo sapiens
MENMFLQSSMLTCIFLLISGSCELCAEENFSRSYPCDEKKQNDSVIAECSNRRLQEVPQTVGKYVTELDLSDNFITHITNESFQGLQNLTKINLNHNPNVQHQNGNPGIQSNGLNITDGAFLNLKNLRELLLEDNQLPQIPSGLPESLTELSLIQNNIYNITKEGISRLINLKNLYLAWNCYFNKVCEKTNIEDGVFETLTNLELLSLSFNSLSHVPPKLPSSLRKLFLSNTQIKYISEEDFKGLINLTLLDLSGNCPRCFNAPFPCVPCDGGASINIDRFAFQNLTQLRYLNLSSTSLRKINAAWFKNMPHLKVLDLEFNYLVGEIASGAFLTMLPRLEILDLSFNYIKGSYPQHINISRNFSKLLSLRALHLRGYVFQELREDDFQPLMQLPNLSTINLGINFIKQIDFKLFQNFSNLEIIYLSENRISPLVKDTRQSYANSSSFQRHIRKRRSTDFEFDPHSNFYHFTRPLIKPQCAAYGKALDLSLNSIFFIGPNQFENLPDIACLNLSANSNAQVLSGTEFSAIPHVKYLDLTNNRLDFDNASALTELSDLEVLDLSYNSHYFRIAGVTHHLEFIQNFTNLKVLNLSHNNIYTLTDKYNLESKSLVELVFSGNRLDILWNDDDNRYISIFKGLKNLTRLDLSLNRLKHIPNEAFLNLPASLTELHINDNMLKFFNWTLLQQFPRLELLDLRGNKLLFLTDSLSDFTSSLRTLLLSHNRISHLPSGFLSEVSSLKHLDLSSNLLKTINKSALETKTTTKLSMLELHGNPFECTCDIGDFRRWMDEHLNVKIPRLVDVICASPGDQRGKSIVSLELTTCVSDVTAVILFFFTFFITTMVMLAALAHHLFYWDVWFIYNVCLAKVKGYRSLSTSQTFYDAYISYDTKDASVTDWVINELRYHLEESRDKNVLLCLEERDWDPGLAIIDNLMQSINQSKKTVFVLTKKYAKSWNFKTAFYLALQRLMDENMDVIIFILLEPVLQHSQYLRLRQRICKSSILQWPDNPKAEGLFWQTLRNVVLTENDSRYNNMYVDSIKQY

SEQ ID NO: 1399 - protein, 1013 aa, Homo sapiens
MGLGTLSPRMLVWLVASGIVFYGELWVCAGLDYDYTFDGNEEDKTETIDYKDPCKAAVFWGDIALDDEDLNIFQIDRTIDLTQNPFGNLGHTTGGLGDHAMSKKRGALYQLIDRIRRIGFGLEQNNTVKGKVPLQFSGQNEKNRVPRAATSRTERIWPGGVIPYVIGGNFTGSQRAMFKQAMRHWEKHTCVTFIERSDEESYIVFTYRPCGCCSYVGRRGNGPQAISIGKNCDKFGIVVHELGHVIGFWHEHTRPDRDNHVTIIRENIQPGQEYNFLKMEPGEVNSLGERYDFDSIMHYARNTFSRGMFLDTILPSRDDNGIRPAIGQRTRLSKGDIAQARKLYRCPACGETLQESNGNLSSPGFPNGYPSYTHCIWRVSVTPGEKIVLNFTTMDLYKSSLCWYDYIEVRDGYWRKSPLLGRFCGDKLPEVLTSTDSRMWIEFRSSSNWVGKGFAAVYEAICGGEIRKNEGQIQSPNYPDDYRPMKECVWKITVSESYHVGLTFQSFEIERHDNCAYDYLEVRDGTSENSPLIGRFCGYDKPEDIRSTSNTLWMKFVSDGTVNKAGFAANFFKEEDECAKPDRGGCEQRCLNTLGSYQCACEPGYELGPDRRSCEAACGGLLTKLNGTITTPGWPKEYPPNKNCVWQVVAPTQYRISVKFEFFELEGNEVCKYDYVEIWSGLSSESKLHGKFCGAEVPEVITSQFNNMRIEFKSDNTVSKKGFKAHFFSDKDECSKDNGGCQHECVNTMGSYMCQCRNGFVLHDNKHDCKEAECEQKIHSPSGLITSPNWPDKYPSRKECTWEISATPGHRIKLAFSEFEIEQHQECAYDHLEVFDGETEKSPILGRLCGNKIPDPLVATGNKMFVRFVSDASVQRKGFQATHSTECGGRLKAESKPRDLYSHAQFGDNNYPGQVDCEWLLVSERGSRLELSFQTFEVEEEADCGYDYVELFDGLDSTAVGLGRFCGSGPPEEIYSIGDSVLIHFHTDDTINKKGFHIRYKSIRYPDTTHTKK

SEQ ID NO: 1400 - protein, 601 aa, Homo sapiens
MRVVRLLRLRAALTLLGEVPRRPASRGVPGSRRTQKGSGARWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTTTSLNKHLQELMDGLTAKVFRTYNASITLQEQLRALTRAEDSIAAKILSYNRANRVVAILCNHQRATPSTFEKSMQNLQTKIQAKKEQVAEARAELRRARAEHKAQGDGKSRSVLEKKRRLLEKLQEQLAQLSVQATDKEENKQVALGTSKLNYLDPRISIAWCKRFRVPVEKIYSKTQRERFAWALAMAGEDFEF

SEQ ID NO: 1401 - protein, 572 aa, Homo sapiens
MYRSGERLLGSHALPAEQRDFLPLETTNNNNNHHQPGAWARRAGSSASSPPSASSSPHPSAAVPAADPADSASGSSNKRKRDNKASGGRAAGGGRADGGGVVYSGTPWKRRNYNQGVVGLHEEISDFYEYMSPRPEEEKMRMEVVNRIESVIKELWPSADVQIFGSFKTGLYLPTSDIDLVVFGKWENLPLWTLEEALRKHKVADEDSVKVLDKATVPIIKLTDSFTEVKVDISFNVQNGVRAADLIKDFTKKYPVLPYLVLVLKQFLLQRDLNEVFTGGIGSYSLFLMAVSFLQLHPREDACIPNTNYGVLLIEFFELYGRHFNYLKTGIRIKDGGSYVAKDEVQKNMLDGYRPSMLYIEDPLQPGNDVGRSSYGAMQVKQAFDYAYVVLSHAVSPIAKYYPNNETESILGRIIRVTDEVATYRDWISKQWGLKNRPEPSCNGPVSSSSATQSSSSDVDSDATPCKTPKQLLCRPSTGNRVGSQDVSLESSQAVGKMQSTQTTNTSNSTNKSQHGSARLFRSSSKGFQGTTQTSHGSLMTNKQHQGKSNNQYYHGKKRKHKRDAPLSDLCR

SEQ ID NO: 1402 - protein, 627 aa, Homo sapiens [sequence omitted]

SEQ ID NO: 1403 - protein, 2363 aa, Homo sapiens
MAAVLQQVLERTELNKLPKSVQNKLEKFLADQQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTEDVKRLNEKLKESNTTKGELQLKLDELQASDVSVKYREKRLEQEKELLHSQNTWLNTELKTKTDELLALGREKGNEILELKCNLENKKEEVSRLEEQMNGLKTSNEHLQKHVEDLLTKLKEAKEQQASMEEKFHNELNAHIKLSNLYKSAADDSEAKSNELTRAVEELHKLLKEAGEANKAIQDHLLEVEQSKDQMEKEMLEKIGRLEKELENANDLLSATKRKGAILSEEELAAMSPTAAAVAKIVKPGMKLTELYNAYVETQDQLLLEKLENKRINKYLDEIVKEVEAKAPILKRQREEYERAQKAVASLSVKLEQAMKEIQRLQEDTDKANKQSSVLERDNRRMEIQVKDLSQQIRVLLMELEEARGNHVIRDEEVSSADISSSSEVISQHLVSYRNIEELQQQNQRLLVALRELGETREREEQETTSSKITELQLKLESALTELEQLRKSRQHQMQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGILERSETETKQRLSSQIEKLEHEISHLKKKLENEVEQRHTLTRNLDVQLLDTKRQLDTETNLHLNTKELLKNAQKEIATLKQHLSNMEVQVASQSSQRTGKGQPSNKEDVDDLVSQLRQTEEQVNDLKERLKTSTSNVEQYQAMVTSLEESLNKEKQVTEEVRKNIEVRLKESAEFQTQLEKKLMEVEKEKQELQDDKRRAIESMEQQLSELKKTLSSVQNEVQEALQRASTALSNEQQARRDCQEQAKIAVEAQNKYERELMLHAADVEALQAAKEQVSKMASVRQHLEETTQKAESQLLECKASWEERERMLKDEVSKCVCRCEDLEKQNRLLHDQIEKLSDKVVASVKEGVQGPLNVSLSEEGKSQEQILEILRFIRREKEIAETRFEVAQVESLRYRQRVELLERELQELQDSLNAEREKVQVTAKTMAQHEELMKKTETMNVVMETNKMLREEKERLEQDLQQMQAKVRKLELDILPLQEANAELSEKSGMLQAEKKLLEEDVKRWKARNQHLVSQQKDPDTEEYRKLLSEKEVHTKRIQQLTEEIGRLKAEIARSNASLTNNQNLIQSLKEDLNKVRTEKETIQKDLDAKIIDIQEKVKTITQVKKIGRRYKTQYEELKAQQDKVMETSAQSSGDHQEQHVSVQEMQELKETLNQAETKSKSLESQVENLQKTLSEKETEARNLQEQTVQLQSELSRLRQDLQDRTTQEEQLRQQITEKEEKTRKAIVAAKSKIAHLAGVKDQLTKENEELKQRNGALDQQKDELDVRITALKSQYEGRISRLERELREHQERHLEQRDEPQEPSNKVPEQQRQITLKTTPASGERGIASTSDPPTANIKPTPVVSTPSKVTAAAMAGNKSTPRASIRPMVTPATVTNPTTTPTATVMPTTQVESQEAMQSEGPVEHVPVFGSTSGSVRSTSPNVQPSISQPILTVQQQTQATAFVQPTQQSHPQIEPANQELSSNIVEVVQSSPVERPSTSTAVFGTVSATPSSSLPKRTREEEEDSTIEASDQVSDDTVEMPLPKKLKSVTPVGTEEEVMAEESTDGEVETQVYNQDSQDSIGEGVTQGDYTPMEDSEETSQSLQIDLGPLQSDQQTTTSSQDGQGKGDDVIVIDSDDEEEDDDENDGEHEDYEEDEEDDDDDEDDTGMGDEGEDSNEGTGSADGNDGYEADDAEGGDGTDPGTETEESMGGGEGNHRAADSQNSGEGNTGAAESSFSQEVSREQQPSSASERQAPRAPQSPRRPPHPLPPRLTIHAPPQELGPPVQRIQMTRRQSVGRGLQLTPGIGGMQQHFFDDEDRTVPSTPTLVVPHRTDGFAEAIHSPQVAGVPRFRFGPPEDMPQTSSSHSDLGQLASQGGLGMYETPLFLAHEEESGGRSVPTTPLQVAAPVTVFTESTTSDASEHASQSVPMVTTSTGTLSTTNETATGDDGDEVFVEAESEGISSEAGLEIDSQQEEEPVQASDESDLPSTSQDPPSSSSVDTSSSQPKPFRRVRLQTTLRQGVRGRQFNRQRGVSHAMGGRGGINRGNIN

SEQ ID NO: 1404 - protein, 333 aa, Homo sapiens; identical to SEQ ID NO: 1254

SEQ ID NO: 1405 - protein, 75 aa, Homo sapiens
MSTCSTGMGCHWPVRPLLTRTSPELLRGLVVSVPSTRPRSPGFSSTYRPVPSWGECQPPWRLRPCRTHMLSSLMG

SEQ ID NO: 1406 - protein, 784 aa, Homo sapiens
MSDQKKEEEEEAAAAAAMATEGGKTSEPENNNKKPKTSGSQDSQPSPLALLAATCSKIGTPGENQATGQQQIIIDPSQGLVQLQNQPQQLELVTTQLAGNAWQLVASTPPASKENNVSQPASSSSSSSSSNNGSASPTKTKSGNSSTPGQFQVIQVQNPSGSVQYQVIPQLQTVEGQQIQINPTSSSSLQDLQGQIKLISAGNNQAILTAANRTASGNILAQNLANQTVPVQIRPGVSIPLQLQTLPGTQAQVVTTLPINIGGVTLALPVINNVAAGGGTGQVGQPAATADSGTSNGNQLVSTPTNTTTSASTMPESPSSSTTCTTTASTSLTSSDTLVSSADTGQYASTSASSSERTIEESQTPAATESEAQSSSQLHANGMQNQQDQSNSLQQVQIVGQPILQQIQIQQPQQQIIQAIPPQSFQLQSGQTIQTIQQQPLQNVQLQAVNPTQVLIRAPTLTPSGQISWQTVQVQNIQSLSNLQVQNAGLSQQLTITPVSSSGGTTLAQIAPVAVAGAPITLNTAQLASVPNLQTVSVANLGAAGVQVQGVPVTITSVAGQQQGQDGVKVQQATIAPVTVAVGGIANATIGAVSPDQLTQVHLQQGQQTSDQEVQPGKRLRRVACSCPNCREGEGRGSNEPGKKKQHICHIEGCGKVYGKTSHLRAHLRWHTGERPFICNWMFCGKRFTRSDELQRHRRTHTGEKRFECPECSKRFMRSDHLSKHVKTHQNKKGGGTALAIVTSGELDSSVTEVLGSPRIVTVAAISQDSNPATPNVSTNMEEF

SEQ ID NO: 1407 - protein, 1872 aa, Homo sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 1408 - protein, 663 aa, Homo sapiens [sequence omitted]

SEQ ID NO: 1409 - protein, 619 aa, Homo sapiens
MAASPGSGSANPRKFSEKIALHTQRQAEETRAFEQLMTDLTLSRVQFQKLQQLRLTQYHGGSLPNVSQLRSNASEFQPSFHQADNVRGTRHHGLVERPSRNRFHPLHRRSGDKPGRQFDGSAFGANYSSQPLDESWPRQQPPWKDEKHPGFRLTSALNRTNSDSALHTSALSTKPQDPYGGGGQSAWPAPYMGFCDGENNGHGEVASFPGPLKEENLLNVPKPLPKQLWETKEIQSLSGRPRSCDVGGGNAFPHNGQNLGLSPFLGTLNTGGSLPDLTNLHYSTPLPASLDTTDHHFGSMSVGNSVNNIPAAMTHLGIRSSSGLQSSRSNPSIQATLNKTVLSSSLNNHPQTSVPNASALHPSLRLFSLSNPSLSTTNLSGPSRRRQPPVSPLTLSPGPEAHQGFSRQLSSTSPLAPYPTSQMVSSDRSQLSFLPTEAQAQVSPPPPYPAPQELTQPLLQQPRAPEAPAQQPQAASSLPQSDFQLLPAQGSSLTNFFPDVGFDQQSMRPGPAFPQQVPLVQQGSRELQDSFHLRPSPYSNCGSLPNTILPEDSSTSLFKDLNSALAGLPEVSLNVDTPFPLEEELQIEPLSLDGLNMLSDSSMGLLDPSVEETFRADRL

SEQ ID NO: 1410 - protein, 712 aa, Homo sapiens [sequence omitted]

SEQ ID NO: 1411 - protein, 677 aa, Homo sapiens; identical to SEQ ID NO: 1387

SEQ ID NO: 1412 - protein, 778 aa, Homo sapiens
MTTRQATKDPLLRGVSPTPSKIPVRSQKRTPFPTVTSCAVDQENQDPRRWVQKPPLNIQRPLVDSAGPRPKARHQAETSQRLVGISQPRNPLEELRPSPRGQNVGPGPPAQTEAPGTIEFVADPAALATILSGEGVKSCHLGRQPSLAKRVLVRGSQGGTTQRVQGVRASAYLAPRTPTHRLDPARASCFSRLEGPGPRGRTLCPQRLQALISPSGPSFHPSTHPSFQELRRETAGSSRTSVSQASGLLLETPVQPAFSLPKGEREVVTHSDEGGVASLGLAQRVPLRENREMSHTRDSHDSHLMPSPAPVAQPLPGHVVPCPSPFGRAQRVPSPGPPTLTSYSVLRRLTVQPKTRFTPMPSTPRVQQAQWLRGVSPQSCSEDPALPWEQVAVRLFDQESCIRSLEGSGKPPVATPSGPHSNRTPSLQEVKIQRIGILQQLLRQEVEGLVGGQCVPLNGGSSLDMVELQPLLTEISRTLNATEHNSGTSHLPGLLKHSGLPKPCLPEECGEPQPCPPAEPGPPEAFCRSEPEIPEPSLQEQLEVPEPYPPAEPRPLESCCRSEPEIPESSRQEQLEVPEPCPPAEPRPLESYCRIEPEIPESSRQEQLEVPEPCPPAEPGPLQPSTQGQSGPPGPCPRVELGASEPCTLEHRSLESSLPPCCSQWAPATTSLIFSSQHPLCASPPICSLQSLRPPAGQAGLSNLAPRTLALRERLKSCLTAIHCFHEARLDDECAFYTSRAPPSGPTRVCTNPVATLLEWQDALCFIPVGSAAPQGSP

SEQ ID NO: 1413 - protein, 471 aa, Homo sapiens
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 1414 - protein, 439 aa, Homo sapiens
MATPDQKSPNVLLQNLCCRILGRSEADVAQQFQYAVRVIGSNFAPTVERDEFLVAEKIKKELIRQRREADAALFSELHRKLHSQGVLKNKWSILYLLLSLSEDPRRQPSKVSSYATLFAQALPRDAHSTPYYYARPQTLPLSYQDRSAQSAQSSGSVGSSGISSIGLCALSGPAPAPQSLLPGQSNQAPGVGDCLRQQLGSRLAWTLTANQPSSQATTSKGVPSAVSRNMTRSRREGDTGGTMEITEAALVRDILYVFQGIDGKNIKMNNTENCYKVEGKANLSRSLRDTAVRLSELGWLHNKIRRYTDQRSLDRSFGLVGQSFCAALHQELREYYRLLSVLHSQLQLEDDQGVNLGLESSLTLRRLLVWTYDPKIRLKTLAALVDHCQGPTRVFPTHVFPTRDFPTRDFPTRDFPMHVFPTRVFPTRVWHSLCFRTRL

SEQ ID NO: 1415 - protein, 281 aa, Homo sapiens
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 1416 - protein, 316 aa, Homo sapiens
MSGDTCLCPASGAKPKLSGFKGGGLGNKYVQLNVGGSLYYTTVRALTRHDTMLKAMFSGRMEVLTDKEGWILIDRCGKHFGTILNYLRDDTITLPQNRQEIKELMAEAKYYLIQGLVNMCQSALQDKKDSYQPVCNIPIITSLKEEERLIESSTKPVVKLLYNRSNNKYSYTSNSDDHLLKNIELFDKLSLRFNGRVLFIKDVIGDEICCWSFYGQGRKLAEVCCTSIVYATEKKQTKVEFPEARIYEETLNVLLYETPRVPDNSLLEATSRSRSQASPSEDEETFELRDRVRRIHVKRYSTYDDRQLGHQSTHRD

SEQ ID NO: 1417 - protein, 1447 aa, Homo sapiens
MENSLRCVWVPKLAFVLFGASLLSAHLQVTGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVPPWFLNHPSNLYAYESMDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITDPTDPVDYYPLLDDFPTSVPDLSTPMLPPVGVQAVALTHDAVRVSWADNSVPKNQKTSEVRLYTVRWRTSFSASAKYKSEDTTSLSYTATGLKPNTMYEFSVMVTKNRRSSTWSMTAHATTYEAAPTSAPKDFTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQGRHGDGGYWPVDTNLIDRSTLNEPPIGQMHPPHGSVTPQKNSNLLVIIVVTVGVITVLVVVIVAVICTRRSSAQQRKKRATHSAGKRKGSQKDLRPPDLWIHHEEMEMKNIEKPSGTDPAGRDSPIQSCQDLTPVSHSQSETQLGSKSTSHSGQDTEEAGSSMSTLERSLAARRAPRAKLMIPMDAQSNNPAVVSAIPVPTLESAQYPGILPSPTCGYPHPQFTLRPVPFPTLSVDRGFGAGRSQSVSEGPTTQQPPMLPPSQPEHSSSEEAPSRTIPTACVRPTHPLRSFANPLLPPPMSAIEPKVPYTPLLSQPGPTLPKTHVKTASLGLAGKARSPLLPVSVPTAPEVSEESHKPTEDSANVYEQDDLSEQMASLEGLMKQLNAITGSAF

SEQ ID NO: 1418 - protein, 929 aa, Homo sapiens [sequence omitted]

SEQ ID NO: 1419 - protein, 281 aa, Homo sapiens
AVPETRPNHTIYINNLNEKIKKDELKKSLYAIFSQFGQILDILVSRSLKMRGQAFVIFKEVSSATNALRSMQGFPFYDKPMRIQYAKTDSDIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPLSENPPNHILFLTNLPEETNELMLSMLFNQFPGFKEVRLVPGRHDIAFVEFDNEVQAGAARDALQGFKITQNNAMKISFAKK

SEQ ID NO: 1420 - protein, 95 aa, Homo sapiens
TSALENYINRTVAVITSDGRMIVGTLKGFDQTINLILDESHERVFSSSQGVEQVVLGLYIVRGDNVAVIGEIDEETDSALDLGNIRAEPLNSVAH

SEQ ID NO: 1421 - protein, 875 aa, Homo sapiens
MEKLHQCYWKSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIGMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 1422 - protein, 531 aa, Homo sapiens
MECPHLSSSVCIAPDSAKFPNGSPSSWCCSVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFNALPFGPPTLGNFRAVSTVFPAQQFCRRILLCLQVNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKWYLLEPENSGPESCLYDLAAVVVHHGSGVGSGHYTAYATHEGRWFHFNDSTVTLTDEETVVKAKAYILFYVEHQAKAGSDKLKLLDLELAPS

SEQ ID NO: 1423 - protein, 508 aa, Homo sapiens
MLWFQGAIPAAIATAKRSGAVFVVFVAGDDEQSTQMAASWEDDKVTEASSNSFVAIKIDTKSEACLQFSQIYPVVCVPSSFFIGDSGIPLEVIAGSVSADELVTRIHKVRQMHLLKSETSVANGSQSESSVSTPSASFEPNNTCENSQSRNAELCEIPPTSDTKSDTATGGESAGHATSSQEPSGCSDQRPAEDLNIRVERLTKKLEERREEKRKEEEQREIKKEIERRKTGKEMLDYKRKQEEELTKRMLEERNREKAEDRAARERIKQQIALDRAERAARFAKTKEEVEAAKAAALLAKQAEMEVKRESYARERSTVARIQFRLPDGSSFTNQFPSDAPLEEARQFAAQTVGNTYGNFSLATMFPRREFTKEDYKKKLLDLELAPSASVVLLPAGRPTASIVHSSSGDIWTLLGTVLYPFLAIWRLISNFLFSNPPPTQTSVRVTSSEPPNPASSSKSEKREPVRKRVLEKRGDDFKKEGKIYRLRTQDDGEDENNTWNGNSTQQM

SEQ ID NO: 1424 - protein, 597 aa, Homo sapiens
MEAEPPLYPMAGAAGPQGDEDLLGVPDGPEAPLDELVGAYPNYNEEEEERRYYRRKRLGVLKNVLAASAGGMLTYGVYLGLLQMQLILHYDETYREVKYGNMGLPDIDSKMLMGINVTPIAALLYTPVLIRFFGTKWMMFLAVGIYALFVSTNYWERYYTLVPSAVALGMAIVPLWASMGNYITRMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVAFLAMLLVLGLCGAAYRPTEEIDLRSVGWGNIFQLPFKHVRDYRLRHLVPFFIYSGFEVLFACTGIALGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAAAVSYLRMEQKLRRGVAPRQPRIPRPQHKVRGYRYLEEDNSDESDAEGEHGDGAEEEAPPAGPRPGPEPAGLGRRPCPYEQAQGGDGPEEQ

SEQ ID NO: 1425 - protein, 149 aa, Homo sapiens
MAQAPADPGREGHLEQRILQVLTEAGSPVKLAQLVKECQAPKRELNQVLYRMKKELKVSLTSPATWCLGGTDPEGEGPAELALSSPGNCHPGEAGLTLQGASWQWTSTDLSLGSNLNSATWELTGFLSLCLGFFFWLMELTAGLLGRGC

SEQ ID NO: 1426 - protein, 822 aa, Homo sapiens
MELELNEKINEEITHIQEEKQDIIISFQHMQQLLRQQIQANTEMEAELKVLKENNQTLERDNELQREKVKENEEKFLNLQNEHEKALGTWKRHAEELNGEINKIKNELSSLKETHIKLQEHYNKLCNQKTFEEDKKFQNVPEVNNENSEMSTEKSENTIIQKYNTEQEIREENMENFCSDTEYREKEEKKEGSFIEEIIIDDLQLFEKSFKNEIDTVVSQDENQSEISLSKTLSLDKEVISQGQTSNVTDNRKSVTTEIKDKICLEKDNGCTEFKSPNNHFVVLDTAIETEKIHLERTRGLDVHHTDVNLEVENNKTSFNSILNETAHNTYHNNNKDVSENEPFKQFRLLPGTREHALEKEITNSDQTKADLDSSLDIKKNPVPCQKYSLRNSSNVMLDDKQCKIKQIQLLTKKSECSILLSKQTSDFLQVCNDTLEKSELTVPCDIVIDHHVSYAAFSANSKLLLKNSDKNVHSMSMLVKPNSSPGGKTMCKNMSDMQNSQFNNCLGYLENTNVNISHLHLNNENSHASQAKDVKTAVHMKTCTETEFSNKKNQIDENQVTEATKNDLFLFVSINERQHTLLNNTEKTESLNDIVSGKMFSEGQLEESHSFHIEPSGDLVNRSGRSTFDLSTSDKKTEKTPVYMNFSDPGPWSKVNHIESQTASSSTPCISLLLKERPLDPSENKKIISMALCKNIGVDDVGKDIGPDTTSINRVADTLNNWSIHPDPKGEPSEEKNAMAKTFYDSSFPTEHVKTKPLISTPLQSHLQAIKTTKNTSGDDDWQSLITNQLNKSENLLSLENDNQPKKRKAEETLEKNNRLK

SEQ ID NO: 1427 - protein, 383 aa, Homo sapiens
MAVFKKQLQMKMCALEEEKGKYQLATEIKEKEIEGLKETLKALQVSKYSLQKKVSEMEQKVQLHLLAKEDYHKQLSEIEKYYATITGQFGLVKENHEKLEQNVREAIQSNKRLSALNKKQEAEICSLKKELKKAASDLIKSKVTCQYKMGEENINLTIKEQKFQELQERLNMELELNEKINEEITHIQEEKQQLLRQQIQANTEMEAELKVLKENNQTLERDNELQREKVKENEEKFLNLQNEHEKALGTWKRHAEELNGEINKIKNELSSLKETHIKLQEHYNKLCNQKTFEEDKKFQNVPEVNNENSEMSTEKSENTIIQKYNTEQEIREENMENFCSDTEYREKEEKKEGSFIEEIIIDGNLKIILIFSNLYVDIYSKYF

SEQ ID NO: 1428 - protein, 1032 aa, Homo sapiens
MPGRAEAGEAEEEAGAGSGSEAEEDALWERIEGVRHRLARALNPAKLTPYLRQCRVIDEQDEEEVLSTYRFPCRVNRTGRLMDILRCRGKRGYEAFLEALEFYYPEHFTLLTGQEPAQRCSMILDEEGPEGLTQFLMTEVRRLREARKSQLQREQQLQARGRVLEEERAGLEQRLRDQQQAQERCQRLREDWEAGSLELLRLKDENYMIAMRLAQLSEEKNSAVLRSRDLQLAVDQLKLKVSRLEEECALLRRARGPPPGAEEKEKEKEKEKEPDNVDLVSELRAENQQLTASLRELQEGLQQEASRPGAPGSERILLDILEHDWREAQDSRQELCQKLHAVQGELQWAEELRDQYLQEMEDLRLKHRTLQKDCDLYKHRMATVLAQLEEIEKERDQAIQSRDRIQLQYSQSLIEKDQYRKQVRGLEAERDELLTTLTSLEGTKALLEVQLQRAQGGTCLKACASSHSLCSNLSSTWSLSEFPSPLGGPEATGEAAVMGGPEPHNSEEATDSEKEINRLSILPFPPSAGSILRRQREEDPAPPKRSFSSMSDITGSVTLKPWSPGLSSSSSSDSVWPLGKPEGLLARGCGLDFLNRSLAIRVSGRSPPGGPEPQDKGPDGLSFYGDRWSGAVVRRVLSGPGSARMEPREQRVEAAGLEGACLEAEAQQRTLLWNQGSTLPSLMDSKACQSFHEALEAWAKGPGAEPFYIRANLTLPERADPHALCVKAQEILRLVDSAYKRRQEWFCTRVDPLTLRDLDRGTVPNYQRAQQLLEVQEKCLPSSRHRGPRSNLKKRALDQLRLVRPKPVGAPAGDSPDQLLLEPCAEPERSLRPYSLVRPLLVSALRPVVLLPECLAPRLIRNLLDLPSSRLDFQVCPAESLSGEELCPSSAPGAPKAQPATPGLGSRIRAIQESVGKKHCLLELGARGVRERVQNEIYPIVIHVEVTEKNVREVRGLLGRPGWRDSELLRQCRGSEQVLWGLPCSWVQVPAHEWGHAEELAKVVRGRILQEQARLVWVECGSSRGCPSSSEA

SEQ ID NO: 1429 - protein, 1047 aa, Homo sapiens
MAVTLDKDAYYRRVKRLYSNWRKGEDEYANVDAIVVSVGVDEEIVYAKSTALQTWLFGYELTDTIMVFCDDKIIFMASKKKVEFLKQIANTKGNENANGAPAITLLIREKNESNKSSFDKMIEAIKESKNGKKIGVFSKDKFPGEFMKSWNDCLNKEGFDKIDISAVVAYTIAVKEDGELNLMKKAASITSEVFNKFFKERVMEIVDADEKVRHSKLAESVEKAIEEKKYLAGADPSTVEMCYPPIIQSGGNYNLKFSVVSDKNHMHFGAITCAMGIRFKSYCSNLVRTLMVDPSQEVQENYNFLLQLQEELLKELRHGVKICDVYNAVMDVVKKQKPELLNKITKNLGFGMGIEFREGSLVINSKNQYKLKKGMVFSINLGFSDLTNKEGKKPEEKTYALFIGDTVLVDEDGPATVLTSVKKKVKNVGIFLKNEDEEEEEEEKDEAEDLLGRGSRAALLTERTRNEMTAEEKRRAHQKELAAQLNEEAKRRLTEQKGEQQIQKARKSNVSYKNPSLMPKEPHIREMKIYIDKKYETVIMPVFGIATPFHIATIKNISMSVEGDYTYLRINFYCPGSALGRNEGNIFPNPEATFVKEITYRASNIKAPGEQTVPALNLQNAFRIIKEVQKRYKTREAEEKEKEGIVKQDSLVINLNRSNPKLKDLYIRPNIAQKRMQGSLEAHVNGFRFTSVRGDKVDILYNNIKHALFQPCDGEMIIVLHFHLKNAIMFGKKRHTDVQFYTEVGEITTDLGKHQHMHDRDDLYAEQMEREMRHKLKTAFKNFIEKVEALTKEELEFEVPFRDLGFNGAPYRSTCLLQPTSSALVNATEWPPFVVTLDEVELIHFERVQFHLKNFDMVIVYKDYSKKVTMINAIPVASLDPIKEWLNSCDLKYTEGVQSLNWTKIMKTIVDDPEGFFEQGGWSFLEPEGEGSDAEEGDSESEIEDETFNPSEDDYEEEEEDSDEDYSSEAEESDYSKESLGSEEESGKDWDELEEEARKADRESRYEEEEEQSRSMSRKRKASVHSSGRGSNRGSRHSSAPPKKKRK

SEQ ID NO: 1430 - protein, 88 aa, Homo sapiens
MKLLYLFLAILLAIEEPVISVECWMDGHCRLLCKDGEDSIIRCRNRKRCCVPSRYLTIQPVTIHGILGWTTPQMSTTAPKMKTNITNR

SEQ ID NO: 1431 - protein, 734 aa, Homo sapiens
MAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 1432 - protein, 1374 aa, Homo sapiens
MMQGNTCHRMSFHPGRGCPRGRGGHGARPSAPSFRPQNLRLLHPQQPPVQYQYEPPSAPSTTFSNSPAPNFLPPRPDFVPFPPPMPPSAQGPLPPCPIRPPFPNHQMRHPFPVPPCFPPMPPPMPCPNNPPVPGAPPGQGTFPFMMPPPSMPHPPPPPVMPQQVNYQYPPGYSHHNFPPPSFNSFQNNPSSFLPSANNSSSPHFRHLPPYPLPKAPSERRSPERLKHYDDHRHRDHSHGRGERHRSLDRRERGRSPDRRRQDSRYRSDYDRGRTPSRHRSYERSRERERERHRHRDNRRSPSLERSYKKEYKRSGRSYGLSVVPEPAGCTPELPGEIIKNTDSWAPPLEIVNHRSPSREKKRARWEEEKDRWSDNQSSGKDKNYTSIKEKEPEETMPDKNEEEEEELLKPVWIRCTHSENYYSSDPMDQVGDSTVVGTSRLRDLYDKFEEELGSRQEKAKAARPPWEPPKTKLDEDLESSSESECESDEDSTCSSSSDSEVFDVIAEIKRKKAHPDRLHDELWYNDPGQMNDGPLCKCSAKARRTGIRHSIYPGEEAIKPCRPMTNNAGRLFHYRITVSPPTNFLTDRPTVIEYDDHEYIFEGFSMFAHAPLTNIPLCKVIRFNIDYTIHFIEEMMPENFCVKGLELFSLFLFRDILELYDWNLKGPLFEDSPPCCPRFHFMPRFVRFLPDGGKEVLSMHQILLYLLRCSKALVPEEEIANMLQWEELEWQKYAEECKGMIVTNPGTKPSSVRIDQLDREQFNPDVITFPIIVHFGIRPAQLSYAGDPQYQKLWKSYVKLRHLLANSPKVKQTDKQKLAQREEALQKIRQKNTMRREVTVELSSQGFWKTGIRSDVCQHAMMLPVLTHHIRYHQCLMHLDKLIGYTFQDRCLLQLAMTHPSHHLNFGMNPDHARNSLSNCGIRQPKYGDRKVHHMHMRKKGINTLINIMSRLGQDDPTPSRINHNERLEFLGDAVVEFLTSVHLYYLFPSLEEGGLATYRTAIVQNQHLAMLAKKLELDRFMLYAHGPDLCRESDLRHAMANCFEALIGAVYLEGSLEEAKQLFGRLLFNDPDLREVWLNYPLHPLQLQEPNTDRQLIETSPVLQKLTEFEEAIGVIFTHVRLLARAFTLRTVGFNHLTLGHNQRMEFLGDSIMQLVATEYLFIHFPDHHEGHLTLLRSSLVNNRTQAKVAEELGMQEYAITNDKTKRPVALRTKTLADLLESFIAALYIDKDLEYVHTFMNVCFFPRLKEFILNQDWNDPKSQLQQCCLTLRTEGKEPDIPLYKTLQTVGPSHARTYTVAVYFKGERIGCGKGPSIQQAEMGAAMDALEKYNFPQMAHQKRFIERKYRQELKEMRWEREHQEREPDETEDIKK

SEQ ID NO: 1433 - protein, 994 aa, Homo sapiens
MRPVALLLLPSLLALLAHGLSLEAPTVGKGQAPGIEETDGELTAAPTPEQPERGVHFVTTAPTLKLLNHHPLLEEFLQEGLEKGDEELRPALPFQPDPPAPFTPSPLPRLANQDSRPVFTSPTPAMAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHLPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVAKAPAASSTLDAAHIAAAIFLPLVAMVLLVGGVYFYFSRLQGKSSLQLPRPRPRPYNRITIESAFDNPTYETGSLSFAGDERI

SEQ ID NO: 1434 - protein, 207 aa, Homo sapiens
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 1435 - protein, 625 aa, Homo sapiens [sequence omitted]

SEQ ID NO: 1436 - protein, 152 aa, Homo sapiens
MASSLNEDPEGSRITYVKGDLFACPKTDSLAHCISEDCRMGAGIAVLFKKKFGGVQELLNQQKKSGEVAVLKRDGRYIYYLITKKRASHKPTYENLQKSLEAMKSHCLKNGVTDLSMPRIGCGLDRLQWENVSAMIEEVFEATDIKITVYTL

SEQ ID NO: 1437 - protein, 600 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQIFELNKHISAVECLLTYLENTVVPPLAKGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 1438 - protein, 800 aa, Homo sapiens
MAASGVPRGCDILIVYSPDAEEWCQYLQTLFLSSRQVRSQKILTHRLGPEASFSAEDLSLFLSTRCVVVLLSAELVQHFHKPALLPLLQRAFHPPHRVVRLLCGVRDSEEFLDFFPDWAHWQELTCDDEPETYVAAVKKAISEDSGCDSVTDTEPEDEKVVSYSKQQNLPTVTSPGNLMVVQPDRIRCGAETTVYVIVRCKLDDRVATEAEFSPEDSPSVRMEAKVENEYTISVKAPNLSSGNVSLKIYSGDLVVCETVISYYTDMEEIGNLLSNAANPVAFKIVPYNTETLDKLLTESLKNNIPASGLHLFGINQLEEEDMMTNQRDEELPTLLHFAAKYGLKNLTALLLTCPGALQAYSVANKHGHYPNTIAEKHGFRDLRQFIDEYVETVDMLKSHIKEELMHGEEADAVYESMAHLSTDLLMKCSLNPGCDEDLYESMAAFVPAATEDLYVEMLQASTSNPIPGDGFSRATKDSMIRKFLEGNSMGMTNLERDQCHLGQEEDVYHTVDDDEAFSVDLASRPPVPVPRPETTAPGAHQLPDNEPYIFKVFAEKSQERPGNFYVSSESIRKGPPVRPWRDRPQSSIYDPFAGMKTPGQRQLITLQEQVKLGIVNVDEAVLHFKEWQLNQKKRSESFRFQQENLKRLRDSITRRQREKQKSGKQTDLEITVPIRHSQHLPAKVEFGVYESGPRKSVIPPRTELRRGDWKTDSTSSTASSTSNRSSTRSLLSVSSGMEGDNEDNEVPEVTRSRSPGPPQVDGTPTMSLERPPRVPPRAASQRPPTRETFHPPPPVPPRGR

SEQ ID NO: 1439 - protein, 443 aa, Homo sapiens
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYARERLEEMHVLCQPKETSDSSLVCSRYLQYCRATNLYLDLRNIKRNHDRFKEDFFQSGEIGGHCKLDIRTLTSEGQRKSPLQSWFAELQSYTQLNFRPIEDAKCDIVIEKPTYFMKLDAGVNMYHHFCDFINLYITQHVNNSFSTDVYIVMWDTDGKIRVTILARSTEYRKILNQNELVNALKTVSTFEVQIVDYKYRELGFLDQLRITHNTDIFIGMHGAGLTHLLFLPDWAAVFELYNCEDERCYLDLARLRGVHYITWRRQNKVFPQDKGHHPTLGEHPKFTNYSFDVEEFMYLVLQAADHVLQHPKWPFKKKHDEL

SEQ ID NO: 1440 - protein, 731 aa, Homo sapiens
PEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 1441 - protein, 196 aa, Homo sapiens [sequence omitted]

SEQ ID NO: 1442 - protein, 140 aa, Homo sapiens
MDSRIPYDDYPVVFLPAYENPPAWIPPHERVHHPDYNNELTQFLPRTITLKKPPGAQLGFNIRGGKASQLGIFISKVIPDSDAHRAGLQEGDQVLAVNDVDFQDIEHSKAVEILKTAREISMRVRFFPYNYHRQKERTVH

SEQ ID NO: 1443 - protein, 2077 aa, Homo sapiens
MAEVRKFTKRLSKPGTAAELRQSVSEAVRGSVVLEKAKVVEPLDYENVIAQRKTQIYSDPLRDLLMFPMEDISISVIGRQRRTVQSTVPEDAEKRAQSLFVKECIKTYSTDWHVVNYKYEDFSGDFRMLPCKSLRPEKIPNHVFEIDEDCEKDEDSSSLCSQKGGVIKQGWLHKANVNSTITVTMKVFKRRYFYLTQLPDGSYILNSYKDEKNSKESKGCIYLDACIDVVQCPKMRRHAFELKMLDKYSHYLAAETEQEMEEWLITLKKIIQINTDSLVQEKKETVETAQDDETSSQGKAENIMASLERSMHPELMKYGRETEQLNKLSRGDGRQNLFSFDSEVQRLDFSGIEPDIKPFEEKCNKRFLVNCHDLTFNILGQIGDNAKGPPTNVEPFFINLALFDVKNNCKISADFHVDLNPPSVREMLWGSSTQLASDGSPKGSSPESYIHGIAESQLRYIQQGIFSVTNPHPEIFLVARIEKVLQGNITHCAEPYIKNSDPVKTAQKVHRTAKQVCSRLGQYRMPFAWAARPIFKDTQGSLDLDGRFSPLYKQDSSKLSSEDILKLLSEYKKPEKTKLQIIPGQLNITVECVPVDLSNCITSSYVPLKPFEKNCQNITVEVEEFVPEMTKYCYPFTIYKNHLYVYPLQLKYDSQKTFAKARNIAVCVEFRDSDESDASALKCIYGKPAGSVFTTNAYAVVSHHNQNPEFYDEIKIELPIHLHQKHHLLFTFYHVSCEINTKGTTKKQDTVETPVGFAWVPLLKDGRIITFEQQLPVSANLPPGYLNLNDAESRRQCNVDIKWVDGAKPLLKIKSHLESTIYTQDLHVHKFFHHCQLIQSGSKEVPGELIKYLKCLHAMEIQVMIQFLPVILMQLFRVLTNMTHEDDVPINCTMVLLHIVSKCHEEGLDSYLRSFIKYSFRPEKPSAPQAQLIHETLATTMIAILKQSADFLSINKLLKYSWFFFEIIAKSMATYLLEENKIKLPRGQRFPETYHHVLHSLLLAIIPHVTIRYAEIPDESRNVNYSLASFLKRCLTLMDRGFIFNLINDYISGFSPKDPKVLAEYKFEFLQTICNHEHYIPLNLPMAFAKPKLQRVQDSNLEYSLSDEYCKHHFLVGLLLRETSIALQDNYEIRYTAISVIKNLLIKHAFDTRYQHKNQQAKIAQLYLPFVGLLLENIQRLAGRDTLYSCAAMPNSASRDEFPCGFTSPANRGSLSTDKDTAYGSFQNGHGIKREDSRGSLIPEGATGFPDQGNTGENTRQSSTRSSVSQYNRLDQYEIRSLLMCYLYIVKMISEDTLLTYWNKVSPQELINILILLEVCLFHFRYMGKRNIARVHDAWLSKHFGIDRKSQTMPALRNRSGVMQARLQHLSSLESSFTLNHSSTTTEADIFHQALLEGNTATEVSLTVLDTISFFTQCFKTQLLNNDGHNPLMKKVFDIHLAFLKNGQSEVSLKHVFASLRAFISKFPSAFFKGRVNMCAAFCYEVLKCCTSKISSTRNEASALLYLLMRNNFEYTKRKTFLRTHLQIIIAVSQLIADVALSGGSRFQESLFIINNFANSDRPMKATAFPAEVKDLTKRIRTVLMATAQMKEHEKDPEMLIDLQYSLAKSYASTPELRKTWLDSMAKIHVKNGDFSEAAMCYVHVAALVAEFLHRKKLFPNGCSAFKKITPNIDEEGAMKEDAGMMDVHYSEEVLLELLEQCVDGLWKAERYEIISEISKLIVPIYEKRREFEKLTQVYRTLHGAYTKILEVMHTKKRLLGTFFRVAFYGQSFFEEEDGKEYIYKEPKLTGLSEISLRLVKLYGEKFGTENVKIIQDSDKVNAKELDPKYAHIQVTYVKPYFDDKELTERKTEFERNHNISRFVFEAPYTLSGKKQGCIEEQCKRRTILTTSNSFPYVKKRIPINCEQQINLKPIDVATDEIKDKTAELQKLCSSTDVDMIQLQLKLQGCVSVQVNAGPLAYARAFLNDSQASKYPPKKVSELKDMFRKFIQACSIALELNERLIKEDQVEYHEGLKSNFRDMVKELSDIIHEQASIRILQEDTMHSPWMSNTLHVFCAISGTSSDRGYGSPRYAEV

SEQ ID NO: 1444 - protein, 172 aa, Homo sapiens
MAQVPAAGLSQALAAGLSRVPAAGLSQALAAAGLSRVLAVGTSPVLALGSRVLGASCCLPCTGLWALTALVLFHLRQFTSGGQRRLLPGWSTSVSVSIRTSSHGTTSGALSSCTWSGGTSRYFHRRLPGTCTWACTQLPSLPSSPPTWPCPSITILLRLSCIPQVGAAVALI

SEQ ID NO: 1445 - protein, 1609 aa, Homo sapiens [sequence omitted]

SEQ ID NO: 1446 - protein, 1382 aa, Homo sapiens
MTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQRTRLIFDALLGICFCIASVLGPILIIPKILEYSEEQLGNVVHGVGLCFALFLSECVKSLSFSSSWIINQRTAIRFRAAVSSFAFEKLIQFKSVIHITSGEAISFFTGDVNYLFEGVCYGPLVLITCASLVICSISSYFIIGYTAFIAILCYLLVFPLAVFMTRMAVKAQHHTSEVSDQRIRVTSEVLTCIKLIKMYTWEKPFAKIIEDLRRKERKLLEKCGLVQSLTSITLFIIPTVATAVWVLIHTSLKLKLTASMAFSMLASLNLLRLSVFFVPIAVKGLTNSKSAVMRFKKFFLQESPVFYVQTLQDPSKALVFEEATLSWQQTCPGIVNGALELERNGHASEGMTRPRDALGPEEEGNSLGPELHKINLVVSKGMMLGVCGNTGSGKSSLLSAILEEMHLLEGSVGVQGSLAYVPQQAWIVSGNIRENILMGGAYDKARYLQVLHCCSLNRDLELLPFGDMTEIGERGLNLSGGQKQRISLARAVYSDRQIYLLDDPLSAVDAHVGKHIFEECIKKTLRGKTVVLVTHQLQYLEFCGQIILLENGKICENGTHSELMQKKGKYAQLIQKMHKEATSDMLQDTAKIAEKPKVESQALATSLEESLNGNAVPEHQLTQEEEMEEGSLSWRVYHHYIQAAGGYMVSCIIFFFVVLIVFLTIFSFWWLSYWLEQGSGTNSSRESNGTMADLGNIADNPQLSFYQLVYGLNALLLICVGVCSSGIFTKVTRKASTALHNKLFNKVFRCPMSFFDTIPIGRLLNCFAGDLEQLDQLLPIFSEQFLVLSLMVIAVLLIVSVLSPYILLMGAIIMVICFIYYMMFKKAIGVFKRLENYSRSPLFSHILNSLQGLSSIHVYGKTEDFISQFKRLTDAQNNYLLLFLSSTRWMALRLEIMTNLVTLAVALFVAFGISSTPYSFKVMAVNIVLQLASSFQATARIGLETEAQFTAVERILQYMKMCVSEAPLHMEGTSCPQGWPQHGEIIFQDYHMKYRDNTPTVLHGINLTIRGHEVVGIVGRTGSGKSSLGMALFRLVEPMAGRILIDGVDICSIGLEDLRSKLSVIPQDPVLLSGTIRFNLDPFDRHTDQQIWDALERTFLTKAISKFPKKLHTDVVENGGNFSVGERQLLCIARAVLRNSKIILIDEATASIDMETDTLIQRTIREAFQGCTVLVIAHRVTTVLNCDHILVMGNGKVVEFDRPEVLRKKPGSLFAALMATATSSLR

SEQ ID NO: 1447 - protein, 548 aa, Homo sapiens
MAAPPARADADPSPTSPPTARDTPGRQAEKSETACEDRSNAESLDRLLPPVGTGRSPRKRTTSQCKSEPPLLRTSKRTIYTAGRPPWYNEHGTQSKEAFAIGLGGGSASGKTTVARMIIEALDVPWVVLLSMDSFYKVLTEQQQEQAAHNNFNFDHPDAFDFDLIISTLKKLKQGKSVKVPIYDFTTHSRKKDWKTLYGANVIIFEGIMAFADKTLLELLDMKIFVDTDSDIRLVRRLRRDISERGRDIEGVIKQYNKFVKPSFDQYIQPTMRLADIVVPRGSGNTVAIDLIVQHVHSQLEERELSVRAALASAHQCHPLPRTLSVLKSTPQVRGMHTIIRDKETSRDEFIFYSKRLMRLLIEHALSFLPFQDCVVQTPQGQDYAGKCYAGKQITGVSILRAGETMEPALRAVCKDVRIGTILIQTNQLTGEPELHYLRLPKDISDDHVILMDCTVSTGAAAMMAVRVLLDHDVPEDKIFLLSLLMAEMGVHSVAYAFPRVRIITTAVDKRVNDLFRIIPGIGNFGDRYFGTDAVPDGSDEEEVAYTG

SEQ ID NO: 1448 - protein, 500 aa, Homo sapiens; identical to SEQ ID NO: 832

SEQ ID NO: 1449 - protein, 390 aa, Homo sapiens
MISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMVPAQSQAGSLV

SEQ ID NO: 1450 - protein, 639 aa, Homo sapiens
MEIIRSNFKSNLHKVYQAIEEADFFAIDGEFSGISDGPSVSALTNGFDTPEERYQKLKKHSMDFLLFQFGLCTFKYDYTDSKYITKSFNFYVFPKPFNRSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKYPKGIHVETLETEKKERYIVISKVDEEERKRREQQKHAKEQEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKLFLMRVMDIPYLNLEGPDLQPKRDHVLHVTFPKEWKTSDLYQLFSAFGNIQISWIDDTSAFVSLSQPEQVKIAVNTSKYAESYRIQTYAEYMGRKQEEKQIKRKWTEDSWKEADSKRLNPQCIPYTLQNHYYRNNSFTAPSTVGKRNLSPSQEEAGLEDGVSGEISDTELEQTDSCAEPLSEGRKKAKKLKRMKKELSPAGSISKNSPATLFEVPDTW

SEQ ID NO: 1451 - protein, 456 aa, Homo sapiens
MEPRCPPPCGCCERLVLNVAGLRFETRARTLGRFPDTLLGDPARRGRFYDDARREYFFDRHRPSFDAVLYYYQSGGRLRRPAHVPLDVFLEEVAFYGLGAAALARLREDEGCPVPPERPLPRRAFARQLWLLFEFPESSQAARVLAVVSVLVILVSIVVFCLETLPDFRDDRDGTGLAAAAAAGPFPAPLNGSSQMPGNPPRLPFNDPFFVVETLCICWFSFELLVRLLVCPSKAIFFKNVMNLIDFVAILPYFVALGTELARQRGVGQQAMSLAILRVIRLVRVFRIFKLSRHSKGLQILGQTLRASMRELGLLIFFLFIGVVLFSSAVYFAEVDRVDSHFTSIPESFWWAVVTMTTVGYGDMAPVTVGGKIVGSLCAIAGVLTISLPVPVIVSNFSYFYHRETEGEEAGMFSHVDMQPCGPLEGKANGGLVDGEVPELPPPLWAPPGKHLVTEV

SEQ ID NO: 1452 - protein, 927 aa, Homo sapiens [sequence omitted]

SEQ ID NO: 1453 - protein, 733 aa, Homo sapiens
MLSFFRRTLGRRSMRKHAEKERLREAQRAATHIPAAGDSKSIITCRVSLLDGTDVSVDLPKKAKGQELFDQIMYHLDLIESDYFGLRFMDSAQVAHWLDGTKSIKKQVKIGSPYCLHLRVKFYSSEPNNLREELTRYLFVLQLKQDILSGKLDCPFDTAVQLAAYNLQAELGDYDLAEHSPELVSEFRFVPIQTEEMELAIFEKWKEYRGQTPAQAETNYLNKAKWLEMYGVDMHVVKARDGNDYSLGLTPTGVLVFEGDTKIGLFFWPKITRLDFKKNKLTLVVVEDDDQGKEQEHTFVFRLDHPKACKHLWKCAVEHHAFFRLRGPVQKSSHRSGFIRLGSRFRYSGKTEYQTTKTNKARRSTSFERRPSKRYSRRTLQMKACATKPEELSVHNNVSTQSNGSQQAWGMRSALPVSPSISSAPVPVEIENLPQSPGTDQHDRKCIPLNIDLLNSPDLLEATIGDVIGASDTMETSQALNDVNVATRLPGLGEPEVEYETLKDTSEKLKQLEMENSPLLSPRSNIDVNINSQEEVVKLTEKCLNNVIESPGLNVMRVPPDFKSNILKAQVEAVHKVTKEDSLLSHKNANVQDAATNSAVLNENNVPLPKESLETLMLITPADSGSVLKEATDELDALLASLTENLIDHTVAPQVSSTSMITPRWIVPQSGAMSNGLAGCEMLLTGKEGHGNKDGISLISPPAPFLVDAVTSSGPILAEEAVLKQKCLLTTEL

SEQ ID NO: 1454 - protein, 143 aa, Homo sapiens [sequence omitted]

SEQ ID NO: 1455 - protein, 1023 aa, Homo sapiens
MGAGALAICQSKAAVRLKEDMKKIVAVPLNEQKDFTYQKLFGVSLQELERQGLTENGIPAVVWNIVEYLTQHGLTQEGLFRVNGNVKVVEQLRLKFESGVPVELGKDGDVCSAASLLKLFLRELPDSLITSALQPRFIQLFQDGRNDVQESSLRDLIKELPDTHYCLLKYLCQFLTKVAKHHVQNRMNVHNLATVFGPNCFHVPPGLEGMKEQDLCNKIMAKILENYNTLFEVEYTENDHLRCENLARLIIVKEVYYKNSLPILLTRGLERDMPKPPPKTKIPKSRSEGSIQAHRVLQPELSDGIPQLSLRLSYRKACLEDMNSAEGAISAKLVPSSQEDERPLSPFYLSAHVPQVSNVSATGELLERTIRSAVEQHLFDVNNSGGQSSEDSESGTLSASSATSARQRRRQSKEQDEVRHGRDKGLINKENTPSGFNHLDDCILNTQEVEKVHKNTFGCAGERSKPKRQKSSTKLSELHDNQDGLVNMESLNSTRSHERTGPDDFEWMSDERKGNEKDGGHTQHFESPTMKIQEHPSLSDTKQQRNQDAGDQEESFVSEVPQSDLTALCDEKNWEEPIPAFSSWQRENSDSDEAHLSPQAGRLIRQLLDEDSDPMLSPRFYAYGQSRQYLDDTEVPPSPPNSHSFMRRRSSSLGSYDDEQEDLTPAQLTRRIQSLKKKIRKFEDRFEEEKKYRPSHSDKAANPEVLKWTNDLAKFRRQLKESKLKISEEDLTPRMRQRSNTLPKSFGSQLEKEDEKKQELVDKAIKPSVEATLESIQRKLQEKRAESSRPEDIKDMTKDQIANEKVALQKALLYYESIHGRPVTKNERQVMKPLYDRYRLVKQILSRANTIPIIGSPSSKRRSPLLQPIIEGETASFFKEIKEEEEGSEDDSNVKPDFMVTLKTDFSARCFLDQFEDDADGFISPMDDKIPSKCSQDTGLSNLHAASIPELLEHLQEMREEKKRIRKKLRDFEDNFFRQNGRNVQKEDRTPMAEEYSEYKHIKAKLRLLEVLISKRDTDSKSM

SEQ ID NO: 1456 - protein, 198 aa, Homo sapiens
MTLKEHAAFKHLFNKAHLAPPLIHLTLSGHSTCFREHRVGGKVIDQQHPKAEESFLVQNKMESPMSTFFYSRHGNNLISLSFPHISPFSIPQNRHCHHGLFSMSCWVRLPDGVAAGQRGSSLPRRGGRAEAPPTSRTGRRPGGGAPHFPDRVAAGRRGSSLLRRGGCWAEGLLTSQTGRPGRDAPHLPDGVAAGQRCS

SEQ ID NO: 1457 - protein, 4388 aa, Homo sapiens
MLEGLVAWVLNTYLGKYVNNLNTDQLSVALLKGAVELENLPLKKDALKELELPFEVKAGFIGKVTLQIPFYRPHVDPWVISISSLHLIGAPEKIQDFNDEKEKLLERERKKALLQALEEKWKNDRQQKGESYWYSVTASVVTRIVENIELKIQDVHLRFEDGVTNPSHPFAFGICIKNVSMQNAVNEPVQKLMRKKQLDVAEFSIYWDVDCTLLGDLPQMELQEAMARSMESRSHHYVLEPVFASALLKRNCSKKPLRSRHSPRIDCDIQLETIPLKLSQLQYRQIMEFLKELERKERQVKFRRWKPKVAISKNCREWWYFALNANLYEIREQRKRCTWDFMLHRARDAVSYTDKYFNKLKGGLLSTDDKEEMCRIEEEQSFEELKILRELVHDRFHKQEELAESLREPQFDSPGACPGAPEPGGGSGMLQYLQSWFPGWGGWYGQQTPEGNVVEGLSAEQQEQWIPEEILGTEEFFDPTADASCMNTYTKRDHVFAKLNLQLQRGTVTLLHKEQGTPQMNESAFMQLEFSDVKLLAESLPRRNSSLLSVRLGGLFLRDLATEGTMFPLLVFPNPQKEVGRVSQSFGLQTTSADRSDHYPAADPDGPVFEMLYERNPAHSHFERRLNVSTRPLNIIYNPQAIKKVADFFYKGKVHTSGFGYQSELELRVAEAARRQYNKLKMQTKAEIRQTLDRLLVGDFIEESKRWTVRLDISAPQVIFPDDFKFKNPVLVVVDLGRMLLTNTQDNSRRKSRDGSASEETQFSDDEYKTPLATPPNTPPPESSSSNGEKTPPFSGVEFSEEQLQAHLMSTKMYERYSLSFMDLQIMVGRVKDNWKHVQDIDVGPTHVVEKFNVHLQLERRLIYTSDPKYPGAVLSGNLPDLKIHINEDKISALKNCFALLTTPEMKTSDTQIKEKIFPQEEQRGSLQDSVMNLTQSIVLLEQHTREVLVESQLLLAEFKVNCMQLGVESNGRYISVLKVFGTNAHFVKRPYDAEVSLTVHGLLLVDTMQTYGADFDLLMASHKNLSFDIPTGSLRDSRAQSPVSGPNVAHLTDGATLNDRSATSVSLDKILTKEQESLIKLEYQFVSSECPSMNLDSTLQVISLQVNNLDIILNPETIVELIGFLQKSFPKEKDDLSPQPLMTDFERSFREQGTYQSTYEQNTEVAVEIHRLNLLLLRTVGMANREKYGRKIATASIGGTKVNVSMGSTFDMNGSLGCLQLMDLTQDNVKNQYVVSIGNSVGYENIISDIGYFESVFVRMEDAALTEALSFTFVERSKQECFLNLKMASLHYNHSAKFLKELTLSMDELEENFRGMLKSAATKVTTVLATKTAEYSEMVSLFETPRKTREPFILEENEIYGFDLASSHLDTVKLILNINIESPVVSIPRKPGSPELLVGHLGQIFIQNFVAGDDESRSDRLQVEIKDIKLYSLNCTQLAGREAVGSEGSRMFCPPSGSGSANSQEEAHFTRHDFFESLHRGQAFHILNNTTIQFKLEKIPIERESELTFSLSPDDLGTSSIMKIEGKFVNPVQVVLAKHVYEQVLQTLDNLVYSEDLNKYPASATSSPCPDSPLPPLSTCGESSVERKENGLFSHSSLSNTSQKSLSVKEVKSFTQIQATFCISELQVQLSGDLTLGAQGLVSLKFQDFEVEFSKDHPQTLSIQIALHSLLMEDLLEKNPDSKYKNLMVSRGAPKPSSLAQKEYLSQSCPSVSNVEYPDMPRSLPSHMEEAPNVFQLYQRPTSASRKKQKEVQDKDYPLTPPPSPTVDEPKILVGKSKFDDSLVHINIFLVDKKHPEFSSSYNRVNRSIDVDFNCLDVLITLQTWVVILDFFGIGSTADNHAMRLPPEGILHNVKLEPHASMESGLQDPVNTKLDLKVHSLSLVLNKTTSELAKANVSKLVAHLEMIEGDLALQGSIGSLSLSDLTCHGEFYRERFTTSGEEALIFQTFKYGRPDPLLRREHDIRVSLRMASVQYVHTQRFQAEVVAFIQHFTQLQDVLGRQRAAIEGQTVRDQAQRCSRVLLDIEAGAPVLLIPESSRSNNLIVANLGKLKVKNKFLFAGFPGTFSLQDKESVPSASPTGIPKHSLRKTTSTEEPRGTHSQGQFTMPLAGMSLGSLKSEFVPSTSTKQQGPQPTLSVGQESSSPEDHVCLLDCVVVDLQDMDIFAAERHPREYSKAPEDSSGDLIFPSYFVRQTGGSLLTEPCRLKLQVERNLDKEISHTVPDISIHGNLSSVHCSLDLYKYKLIRGLLENNLGEPIEEFMRPYDLQDPRIHTVLSGEVYTCMCFLIDMVNVSLELKDPKRKEGAGSLARFDFKKCKLLYESFSNQTKSINLVSHSMMAFDTRYAGQKTSPGMTNVFSCIFQPAKNSSTTQGSIQIELHFRSTKDSSCFTVVLNNLRVFLIFDWLLLVHDFLHTPSDIKKQNHVTPSRHRNSSSESAIVPKTVKSGVVTKRSSLPVSNERHLEVKVNVTGTEFVVIEDVSCFDTNAIILKGTTVLTYKPRFVDRPFSGSLFGIEVFSCRLGNEHDTALSIVDPVQIQMELVGNSSYQNSSGLMDAFNSEDFPPVLEIQLQALDIRLSYNDVQLFLAIAKSIPEQANAAVPDSVALESDSVGTYLPGASRVGEEIREGTRHTLDPVLELQLARLQELGFSMDDCRKALLACQGQLKKAASWLFKNAEPLKSLSLASTSRDSPGAVAAPLISGVEIKAESVCICFIDDCMDCDVPLAELTFSRLNFLQRVRTSPEGYAHFTLSGDYYNRALSGWEPFIEPWPCSVSWQQQAAGRLHPPRLKLEAKAKPRLDINITSVLIDQYVSTKESWMADYCKDDKDIESAKSEDWMGSSVDPPCFGQSLPLVYLRTRSTASLTNLEHQIYARAEVKTPKRRQPFVPFALRNHTGCTLWFATLTTTPTRAALSHSGSPGVVPEGNGTFLDDTHNVSEWREVLTGEEIPFEFEARGKLRHRHTHDLRIHQLQVRVNGWEQVSPVSVDKVGTFFRYAAPDKNSSSSTIGSPSSRTNIIHPQVYFSSLPPVRVVFAVTMEGSARKVITVRSALIVRNRLETPMELRLDSPSAPDKPVVLPAIMPGDSFAVPLHLTSWRLQARPKGLGVFFCKAPIHWTNVVKTAEISSSKRECHSMDTEKSRFFRFCVAIKKENYPDYMPSNIFSDSAKQIFRQPGHTIYLLPTVVICNLLPCELDFYVKGMPINGTLKPGKEAALHTADTSQNIELGVSLENFPLCKELLIPPGTQNYMVRMRLYDVNRRQLNLTIRIVCRAEGSLKIFISAPYWLINKTGLPLIFRQDNAKTDAAGQFEEHELARSLSPLLFCYADKEQPNLCTMRIGRGIHPEGMPGWCQGFSLDGGSGVRALKVIQQGNRPGLIYNIGIDVKKGRGRYIDTCMVIFAPRYLLDNKSSHKLAFAQREFARGQGTANPEGYISTLPGSSVVFHWPRNDYDQLLCVRLMDVPNCIWSGGFEVNKNNSFHINMRDTLGKCFFLRVEITLRGATYRISFSDTDQLPPPFRIDNFSKVPVVFTQHGVAEPRLRTEVKPMTSLDYAWDEPTLPPFITLTVKGAGSSEINCNMNDFQDNRQLYYENFIYIAATYTFSGLQEGTGRPVASNKAITCAELVLDVSPKTQRVILKKKEPGKRSQLWRMTGTGMLAHEGSSVPHNPNKPSAARSTEGSAILDIAGLAAVTDNRYEPLMLRKPDRRRSTTQTWSFREGKLTCGLHGLVVQAKGGLSGLFDGAEVVLGPDTSMELLGPVPPEQQFINQKMRPGSGMLSIRVIPDGPTRALQITDFCHRKSSRSYEVDELPVTEQELQKLKNPDTEQELEVLVRLEGGIGLSLINKVPEELVFASLTGINVHYTQLATSHMLELSIQDVQVDNQLIGTTQPFMLYVTPLSNENEVIETGPAVQVNAVKFPSKSALTNIYKHLMITAQRFTVQIEEKLLLKLLSFFGYDQAESEVEKYDENLHEKTAEQGGTPIRYYFENLKISIPQIKLSVFTSNKLPLDLKALKSTLGFPLIRFEDAVINLDPFTRVHPYETKEFIINDILKHFQEELLSQAARILGSVDFLGNPMGLLNDVSEGVTGLIKYGNVGGLIRNVTHGVSNSAAKFAGTLSDGLGKTMDNRHQSEREYIRYHAATSGEHLVAGIHGLAHGIIGGLTSVITSTVEGVKTEGGVSGFISGLGKGLVGTVTKPVAGALDFASETAQAVRDTATLSGPRTQAQRVRKPRCCTGPQGLLPRYSESQAEGQEQLFKLTDNIQDEFFIAVENIDSYCVLISSKAVYFLKSGDYVDREAIFLEVKYDDLYHCLVSKDHGKVYVQVTKKAVSTSSGVSIPGPSHQKPMVHVKSEVLAVKLSQEINYAKSLYYEQQLMLRLSENREQLELDS

SEQ ID NO: 1458 - protein, 2351 aa, Homo sapiens
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 1459 - protein, 1918 aa, Homo sapiens
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQTQRNQKKKMKKRVKDELRKLNTMTAAEANEIEDVWQLDLSSRWQLYRLWLQLYQADTRRKILSYERQYRTSAERMAELRLQEDLHILKDAQVVGMTTTGAAKYRQILQKVEPRIVIVEEAAEVLEAHTIATLSKACQHLILIGDHQQLRPSANVYDLAKNFNLEVSLFERLVKVNIPFVRLNYQHRMCPEIARLLTPHIYQDLENHPSVLKYEKIKGVSSNLFFVEHNFPEQEIQEGKSHQNQHEAHFVVELCKYFLCQEYLPSQITILTTYTGQLFCLRKLMPAKTFAGVRVHVVDKYQGEENDIILLSLVRSNQEGKVGFLQISNRICVALSRAKKGMYCIGNMQMLAKVPLWSKIIHTLRENNQIGPMLRLCCQNHPETHTLVSKASDFQKVPEGGCSLPCEFRLGCGHVCTRACHPYDSSHKEFQCMKPCQKVICQEGHRCPLVCFQECQPCQVKVPKTIPRCGHEQMVPCSVPESDFCCQEPCSKSLRCGHRCSHPCGEDCVQLCSEMVTIKLKCGHSQPVKCGHVEGLLYGGLLVKCTTKCGTILDCGHPCPGSCHSCFEGRFHERCQQPCKRLLICSHKCQEPCIGECPPCQRTCQNRCVHSQCKKKCGELCSPCVEPCVWRCQHYQCTKLCSEPCNRPPCYVPCTKLLVCGHPCIGLCGEPCPKKCRICHMDEVTQIFFGFEDEPDARFVQLEDCSHIFEVQALDRYMNEQKDDEVAIRLKVCPICQVPIRKNLRYGTSIKQRLEEIEIIKEKIQGSAGEIATSQERLKALLERKSLLHQLLPEDFLMLKEKLAQKNLSVKDLGLVENYISFYDHLASLWDSLKKMHVLEEKRVRTRLEQVHEWLAKKRLSFTSQELSDLRSEIQRLTYLVNLLTRYKIAEKKVKDSIAVEVYSVQNILEKTCKFTQEDEQLVQEKMEALKATLPCSGLGISEEERVQIVSAIGYPRGHWFKCRNGHIYVIGDCGGAMERGTCPDCKEVIGGTNHTLERSNQLASEMDGAQHAAWSDTANNLMNFEEIQGMM

SEQ ID NO: 1460 - protein, 390 aa, Homo sapiens
MEDPTLYIVERPLPGYPDAEAPEPSSAGAQAAEEPSGAGSEELIKSDQVNGVLVLSLLDKIIGAVDQIQLTQAQLEERQAEMEGAVQSIQGELSKLGKAHATTSNTVSKLLEKVRKVSVNVKTVRGSLERQAGQIKKLEVNEAELLRRRNFKVMIYQDEVKLPAKLSISKSLKESEALPEKEGEELGEGERPEEDAAALELSSDEAVEVEEVIEESRAERIKRSGLRRVDDFKKAFSKEKMEKTKVRTRENLEKTRLKTKENLEKTRHTLEKRMNKLGTRLVPAERREKLKTSRDKLRKSFTPDHVVYARSKTAVYKVPPFTFHVKKIREGQVEVLKATEMVEVGADDDEGGAERGEAGDLRRGSSPDVHALLEITEESDAVLVDKSDSD

SEQ ID NO: 1461 - protein, 541 aa, Homo sapiens
MASMGTLAFDEYGRPFLIIKDQDRKSRLMGLEALKSHIMAAKAVANTMRTSLGPNGLDKMMVDKDGDVTVTNDGATILSMMDVDHQIAKLMVELSKSQDDEIGDGTTGVVVLAGALLEEAEQLLDRGIHPIRIADGYEQAARVAIEHLDKISDSVLVDIKDTEPLIQTAKTTLGSKVVNSCHRQMAEIAVNAVLTVADMERRDVDFELIKVEGKVGGRLEDTKLIKGVIVDKDFSHPQMPKKVEDAKIAILTCPFEPPKPKTKHKLDVTSVEDYKALQKYEKEKFEEMIQQIKETGANLAICQWGFDDEANHLLLQNNLPAVRWVGGPEIELIAIATGGRIVPRFSELTAEKLGFAGLVQEISFGTTKDKMLVIEQCKNSRAVTIFIRGGNKMIIEEAKRSLHDALCVIRNLIRDNRVVYGGGAAEISCALAVSQEADKCPTLEQYAMRAFADALEVIPMALSENSGMNPIQTMTEVRARQVKEMNPALGIDCLHKGTNDMKQQHVIETLIGKKQQISLATQMVRMILKIDDIRKPGESEE

SEQ ID NO: 1462 - protein, 796 aa, Homo sapiens
MVLAQRRRGGCEKLRAGPQAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLGKDICACAATGTGKTAAFALPVLERLIYKPRQAPVTRVLVLVPTRELGIQVHSVTRQLAQFCNITTCLAVGGLDVKSQEAALRAAPDILIATPGRLIDHLHNCPSFHLSSIEVLILDEADRMLDEYFEEQMKEIIRMCSHHRQTMLFSATMTDEVKDLASVSLKNPVRIFVNSNTDVAPFLRQEFIRIRPNREGDREAIVAALLTRTFTDHVMLFTQTKKQAHRMHILLGLMGLQVGELHGNLSQTQRLEALRRFKDEQIDILVATDVAARGLDIEGVKTVINFTMPNTIKHYVHRVGRTARAGRAGRSVSLVGEDERKMLKEIVKAAKAPVKARILPQDVILKFRDKIEKMEKDVYAVLQLEAEEKEMQQSEAQINTAKRLLEKGKEAVVQEPERSWFQTKEERKKEKIAKALQEFDLALRGKKKRKKFMKDAKKKGEMTAEERSQFEILKAQMFAERLAKRNRRAKRARAMPEEEPVRGPAKKQKQGKKSVFDEELTNTSKKALKQYRAGPSFEERKQLGLPHQRRGGNFKSKSRYKRRK

SEQ ID NO: 1463 - protein, 299 aa, Homo sapiens
MVDKKLVVVFGGTGAQGGSVARTLLEDGTFKVRVVTRNPRKKAAKELRLQGAEVVQGDQDDQVIMELALNGAYATFIVTNYWESCSQEQEVKQGKLLADLARRLGLHYVVYSGLENIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKMTPEDYEKLGFPGARDLANMFRFYALRPDRDIELTLRLNPKALTLDQWLEQHKGDFNLL

SEQ ID NO: 1464 - protein, 151 aa, Homo sapiens
MDGVDARVSRRRGWHPHEASHTPMGVGIWRHAWGGDALWRHKAGASRAPRSWTGPQGVLQLKREGKKAHEPVASGADFPTQGLSLCPWGPRNFPGNLHLAQIYPLSPPTLAVASQEAPATVLKTKFSSVIPLCSACVIHETGKSPGLQRKK

SEQ ID NO: 1465 - protein, 525 aa, Homo sapiens
MAAVVLAATRLLRGSGSWGCSRLRFGPPAYRRFSSGGAYPNIPLSSPLPGVPKPVFATVDGQEKFETKVTTLDNGLRVASQNKFGQFCTVGILINSGSRYEAKYLSGIAHFLEKLAFSSTARFDSKDEILLTLEKHGGICDCQTSRDTTMYAVSADSKGLDTVVALLADVVLQPRLTDEEVEMTRMAVQFELEDLNLRPDPEPLLTEMIHEAAYRENTVGLHRFCPTENVAKINREVLHSYLRNYYTPDRMVLAGVGVEHEHLVDCARKYLLGVQPAWGSAEAVDIDRSVAQYTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVELERAKTQLTSMLMMNLESRPVIFEDVGRQVLATRSRKLPHELCTLIRNVKPEDVKRVASKMLRGKPAVAALGDLTDLPTYEHIQTALSSKDGRLPRTYRLFR

SEQ ID NO: 1466 - protein, 198 aa, Homo sapiens [sequence omitted]

SEQ ID NO: 1467 - protein, 57 aa, Homo sapiens
MPTGKQLADIGYKTFSTSMMLLTVYGGYLCSVRVYHYFQWRRAQRQAAEEQKTSGIM

SEQ ID NO: 1468 - protein, 4363 aa, Homo sapiens [sequence omitted]

SEQ ID NO: 1469 - protein, 955 aa, Homo sapiens
MWAGLLLRAACVALLLPGAPARGYTGRKPPGHFAAERRRLGPHVCLSGFGSGCCPGWAPSMGGGHCTLPLCSFGCGSGICIAPNVCSCQDGEQGATCPETHGPCGEYGCDLTCNHGGCQEVARVCPVGFSMTEAAVGIRCTDIDECVTSSCEGHCVNTEGGFVCECGPGMQLSADRHSCQDTDECLGTPCQQRCKNSIGSYKCSCRTGFHLHGNRHSCVDVNECRRPLERRVCHHSCHNTVGSFLCTCRPGFRLRADRVSCEAFPKAVLAPSAILQPRQHPSKMLLLLPEAGRPALSPGHSPPSGAPGPPAGVRTTRLPSPTPRLPTSSPSAPVWLLSTLLATPVPTASLLGNLRPPSLLQGEVMGTPSSPRGPESPRLAAGPSPCWHLGAMHESRSRWTEPGCSQCWCEDGKVTCEKVRCEAACSHPIPSRDGGCCPSCTGCFHSGVVRAEGDVFSPPNENCTVCVCLAGNVSCISPECPSGPCQTPPQTDCCTCVPVRCYFHGRWYADGAVFSGGGDECTTCVCQNGEVECSFMPCPELACPREEWRLGPGQCCFTCQEPTPSTGCSLDDNGVEFPIGQIWSPGDPCELCICQADGSVSCKRTDCVDSCPHPIRIPGQCCPDCSAGCTYTGRIFYNNETFPSVLDPCLSCICLLGSVACSPVDCPITCTYPFHPDGECCPVCRDCNYEGRKVANGQVFTLDDEPCTRCTCQLGEVSCEKVPCQRACADPALLPGDCCSSCPDSLSPLEEKQGLSPHGNVAFSKAGRSLHGDTEAPVNCSSCPGPPTASPSRPVLHLLQLLLRTNLMKTQTLPTSPAGAHGPHSLALGLTATFPGEPGASPRLSPGPSTPPGAPTLPLASPGAPQPPPVTPERSFSASGAQIVSRWPPLPGTLLTEASALSMMDPSPSKTPITLLGPRVLSPTTSRLSTALAATTHPGPQQPPVGASRGEESTM

SEQ ID NO: 1470 - protein, 871 aa, Homo sapiens
MADSSEGPRAGPGEVAELPGDESGTPGGEAFPLSSLANLFEGEDGSLSPSPADASRPAGPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGQTALHIAIERRCKHYVELLVAQGADVHAQARGRFFQPKDEGGYFYFGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGIFQHIIRREVTDEDTRHLSRKFKDWAYGPVYSSLYDLSSLDTCGEEASVLEILVYNSKIENRHEMLAVEPINELLRDKWRKFGAVSFYINVVSYLCAMVIFTLTAYYQPLEGTPPYPYRTTVDYLRLAGEVITLFTGVLFFFTNIKDLFMKKCPGVNSLFIDGSFQLLYFIYSVLVIVSAALYLAGIEAYLAVMVFALVLGWMNALYFTRGLKLTGTYSIMIQKILFKDLFRFLLVYLLFMIGYASALVSLLNPCANMKVCNEDQTNCTVPTYPSCRDSETFSTFLLDLFKLTIGMGDLEMLSSTKYPVVFIILLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 1471 - protein, 354 aa, Homo sapiens
MYREWVVVNVFMMLYVQLVQGSSNEHGPVKRSSQSTLERSEQQIRAASSLEELLRITHSEDWKLWRCRLRLKSFTSMDSRSASHRSTRFAATFYDIETLKVIDEEWQRTQCSPRETCVEVASELGKSTNTFFKPPCVNVFRCGGCCNEESLICMNTSTSYISKQLFEISVPLTSVPELVPVKVANHTGCKCLPTAPRHPYSIIRRSIQIPEEDRCSHSKKLCPIDMLWDSNKCKCVLQEENPLAGTEDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 1472 - protein, 1338 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLLIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 1473 - protein, 304 aa, Homo sapiens
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYWDTTTLIEPVSRSRQGSGVILRQEEAEYVRALFDFNGNDEEDLPFKKGDILRIRDKPEEQWWNAEDSEGKRGMIPVPYVEKYRPASASVSALIGGNQEGSHPQPLGPPEPGPYAQPSVNTPLPNLQNGPIYARVIQKRVPNAYDKTALALEVGELVKVTKINVSGQWEGGCNGKRGHFPFTHVRLLDQQNPDEDFS

SEQ ID NO: 1474 - protein, 391 aa, Homo sapiens
MVMFKKIKSFEVVFNDPEKVYGSGEKVAGRVIVEVCEVTRVKAVRILACGVAKVLWMQGSQQCKQTSEYLRYEDTLLLEDQPTGENEMVIMRPGNKYEYKFGFELPQGPLGTSFKGKYGCVDYWVKAFLDRPSQPTQETKKNFEVVDLVDVNTPDLMAPVSAKKEKKVSCMFIPDGRVSVSARIDRKGFCEGDEISIHADFENTCSRIVVPKAAIVARHTYLANGQTKVLTQKLSSVRGNHIISGTCASWRGKSLRVQKIRPSILGCNILRVEYSLLIYVSVPGSKKVILDLPLVIGSRSGLSSRTSSMASRTSSEMSWVDLNIPDTPEAPPCYMDVIPEDHRLESPTTPLLDDMDGSQDSPIFMYAPEFKFMPPPTYTEVDPCILNNNVQ

SEQ ID NO: 1475 - protein, 465 aa, Homo sapiens
STRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTLLIKTVETRDGQVINETSQHHDDLE

SEQ ID NO: 1476 - protein, 466 aa, Homo sapiens
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTLLIKTVETRDGQVINETSQHHDDLE

SEQ ID NO: 1477 - protein, 1133 aa, Homo sapiens
PVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKPGIPAAEVGIGVVAEADAADAAGFPVPPDMEDDYEPELLLMPSNQPVNQPILAAAQSLHREATKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 1478 - protein, 1066 aa, Homo sapiens; identical to SEQ ID NO: 855

SEQ ID NO: 1479 - protein, 2353 aa, Homo sapiens
MTEGARAADEVRVPLGAPPPGPAALVGASPESPGAPGREAERGSELGVSPSESPAAERGAELGADEEQRVPYPALAATVFFCLGQTTRPRSWCLRLVCNPWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPGRRELRMPCTLGWEAYTQPQAEGVGAARNACINWNQYYNVCRSGDSNPHNGAINFDNIGYAWIAIFQVITLEGWVDIMYYVMDAHSFYNFIYFILLIIVGSFFMINLCLVVIATQFSETKQRESQLMREQRARHLSNDSTLASFSEPGSCYEELLKYVGHIFRKVKRRSLRLYARWQSRWRKKVDPSAVQGQGPGHRQRRAGRHTASVHHLVYHHHHHHHHHYHFSHGSPRRPGPEPGACDTRLVRAGAPPSPPSPGRGPPDAESVHSIYHADCHIEGPQERARVAHAAATAAASLRLATGLGTMNYPTILPSGVGSGKGSTSPGPKGKWAGGPPGTGGHGPLSLNSPDPYEKIPHVVGEHGLGQAPGHLSGLSVPCPLPSPPAGTLTCELKSCPYCTRALEDPEGELSGSESGDSDGRGVYEFTQDVRHGDRWDPTRPPRATDTPGPGPGSPQRRAQQRAAPGEPGWMGRLWVTFSGKLRRIVDSKYFSRGIMMAILVNTLSMGVEYHEQPEELTNALEISNIVFTSMFALEMLLKLLACGPLGYIRNPYNIFDGIIVVISVWEIVGQADGGLSVLRTFRLLRVLKLVRFLPALRRQLVVLVKTMDNVATFCTLLMLFIFIFSILGMHLFGCKFSLKTDTGDTVPDRKNFDSLLWAIVTVFQILTQEDWNVVLYNGMASTSSWAALYFVALMTFGNYVLFNLLVAILVEGFQAEGDANRSDTDEDKTSVHFEEDFHKLRELQTTELKMCSLAVTPNGHLEGRGSLSPPLIMCTAATPMPTPKSSPFLDAAPSLPDSRRGSSSSGDPPLGDQKPPASLRSSPCAPWGPSGAWSSRRSSWSSLGRAPSLKRRGQCGERESLLSGEGKGSTDDEAEDGRAAPGPRATPLRRAESLDPRPLRPAALPPTKCRDRDGQVVALPSDFFLRIDSHREDAAELDDDSEDSCCLRLHKVLEPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRSTFPSPEAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 1480 - protein, 625 aa, Homo sapiens
MPRNKMSFSSPGQQVMYPPGYKTQGHGAEPSTSPLSSINYIIQSTETRRSLDKLLKGDIDIGSQNGTDLFGFGNTHEYPDLQMILSGALWCNIHKVSGKACLIFPHRGYNSSKLHNRGICLSLRSRSTVPLVTRNIEPRHLCRQTLPSVRSELECVTNITLANVIRQLGSLSKYAEDIFGELFTQANTFASPVSSLAERVDGLQVKVTQLDPKEEEVSLQVINTRKAFRSSTIQDQKLFDRNSLPVPVLETYNTCDTPPPLNNLTPYRDDGTEALKFYTDPSYFFDLWKKKMLQDTRDIMKEKRKHRKEKKDNPNRGNVNPRKIKTRKEEWEKIKMGQEFVESKEKLGPFGYPPTLVYQNGSIGCVENVDASSYPPPSQSDSASSPSPSFSEDNLPPPPAEFSYPVDNQRGSGLAGPKRSSVVSPSHPPPAPPLGSPPSSKPGFAPPPAPPPPPPPMIGIPPPPPPIGFGSPGTPPPPSSPSFPPHPDFAAPPPLPPPPAADYPTLPPPPLSQPTRGAPPPPPPPPPGPPPPPFTGADGQPAVPPPLSDTTKPKSSLPAISDAHSDLLSAICQGFQLRRVEEQQEQEKWDVVGNDVATILSRRIAVEYSDSEDDSSEFDGDDWSN

SEQ ID NO: 1481 - protein, 108 aa, Homo sapiens
MILQRLFRFSSVIRSAVSVHLRRNIGVTAVAFNKELDPIQKLFVDKIREYKSKRQTSGGPVDASSEYQQELERELFKLKQMFGNADMNTFPTFKFEDPKFEVIEKPQA

SEQ ID NO: 1482 - protein, 355 aa, Homo sapiens
MEPHLLGLLLGLLLGGTRVLAGYPIWWSLALGQQYTSLGSQPLLCGSIPGLVPKQLRFCRNYIEIMPSVAEGVKLGIQECQHQFRGRRWNCTTIDDSLAIFGPVLDKATRESAFVHAIASAGVAFAVTRSCAEGTSTICGCDSHHKGPPGEGWKWGGCSEDADFGVLVSREFADARENRPDARSAMNKHNNEAGRTTILDHMHLKCKCHGLSGSCEVKTCWWAQPDFRAIGDFLKDKYDSASEMVVEKHRESRGWVETLRAKYSLFKPPTERDLVYYENSPNFCEPNPETGSFGTRDRTCNVTSHGIDGCDLLCCGRGHNTRTEKRKEKCHCIFHWCCYVSCQECIRIYDVHTCK

SEQ ID NO: 1483 - protein, 749 aa, Homo sapiens
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPEPGPEDSVEACPPIKASCSPSRHEARPKSLNLLPEAKHPGDPQRGFKPKTRTPEERLKWPHEQVCNGLEQPRKQQRSDLNGPVDNNNIPETKKVASFPSFVAVPGPCEPEDLIDGIIFAANYLGSTQLLSERNPSKNIRMMQAQEAVSRVKRMQKAAKIKKKANSEGDAQTLTEVDLFISTQRIKVLNADTQETMMDHALRTISYIADIGNIVVLMARRRMPRSASQDCIETTPGAQEGKKQYKMICHVFESEDAQLIAQSIGQAFSVAYQEFLRANGINPEDLSQKEYSDIINTQEMYNDDLIHFSNSENCKELQLEKHKGEILGVVVVESGWGSILPTVILANMMNGGPAARSGKLSIGDQIMSINGTSLVGLPLATCQGIIKGLKNQTQVKLNIVSCPPVTTVLIKRPDLKYQLGFSVQNGIICSLMRGGIAERGGVRVGHRIIEINGQSVVATAHEKIVQALSNSVGEIHMKTMPAAMFRLLTGQETPLYI

SEQ ID NO: 1484 - protein, 475 aa, Homo sapiens
MVEDLAASYIVLKLENEIRQAQVQWLMEENAALQAQIPELQKSQAAKEYDLLRKSSEAKEPQKLPEHMNPPAAWEAQKTPEFKEPQKPPEPQDLLPWEPPAAWELQEAPAAPESLAPPATRESQKPPMAHEIPTVLEGQGPANTQDATIAQEPKNSEPQDPPNIEKPQEAPEYQETAAQLEFLELPPPQEPLEPSNAQEFLELSAAQESLEGLIVVETSAASEFPQAPIGLEATDFPLQYTLTFSGDSQKLPEFLVQLYSYMRVRGHLYPTEAALVSFVGNCFSGRAGWWFQLLLDIQSPLLEQCESFIPVLQDTFDNPENMKDANQCIHQLCQGEGHVATHFHLIAQELNWDESTLWIQFQEGLASSIQDELSHTSPATNLSDLITQCISLEEKPDPNPLGKSSSAEGDGPESPPAENQPMQAAINCPHISEAEWVRWHKGRLCLYCGYPGHFARDCPVKPHQALQAGNIQACQ

SEQ ID NO: 1485 - protein, 2880 aa, Homo sapiens
HAHPECLTMEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 1486 - protein, 867 aa, Homo sapiens
MQAEAADWFSSMPFQKHVYYPLASGPEGPDVAVAAAAAGAASMACAPPSAASGPLPFFQFRPRLESVDWRRLSAIDVDKVAGAVDVLTLQENIMNITFCKLEDEKCPHCQSGVDPVLLKLIRLAQFTIEYLLHSQEFLTSQLHTLEERLRLSHCDGEQSKKLLTKQAGEIKTLKEECKRRKKMISTQQLMIEAKANYYQCHFCDKAFMNQAFLQSHIQRRHTEENSHFEYQKNAQIEKLRSEIVVLKEELQLTRSELEAAHHASAVRFSKEYEMQKTKEEDFLKLFDRWKEEEKEKLVDEMEKVKEMFMKEFKELTSKNSALEYQLSEIQKSNMQIKSNIGTLKDAHEFKEDRSPYPQDFHNVMQLLDSQESKWTARVQAIHQEHKKEKGRLLSHIEKLRTSMIDDLNASNVFYKKRIEELGQRLQEQNELIITQRQQIKDFTCNPLNSISEPKGNPLAWQAFESQPAAPAVPMNAPALHTLETKSSLPMVHEQAFSSHILEPIEELSEEEKGRENEQKLNNNKMHLRKALKSNSSLTKGLRTMVEQNLMEKLETLGINADIRGISSDQLHRVLKSVESERHKQEREIPNFHQIREFLEHQVSCKIEEKALLSSDQCSVSQMDTLSTGEVPKMIQLPSKNRQLIRQKAVSTDRTSVPKIKKNVMEDPFPRKSSTITTPPFSSEEEQEDDDLIRAYASPGPLPVPPPQNKGSFGKNTVKSDADGTEGSEIEDTDDSPKPAGVAVKTPTEKVEKMFPHRKNVNKPVGGTNVPEMFIKKEELQELKCADVEDEDWDISSLEEEISLGKKSGKEQKEPPPAKNEPHFAHVLNAWGAFNPKGPKGEGLQENESSTLKSSLVTVTDWSDTSDV

SEQ ID NO: 1487 - protein, 540 aa, Homo sapiens
MEKPAGRKKKTPTPREEADVQKSALREEKVSGDRKPPERPTVPRKPRTEPCLSPEDEEHVFDAFDASFKDDFEGVPVFIPFQRKKPYECSECGRIFKHKTDHIRHQRVHTGEKPFKCAQCGKAFRHSSDVTKHQRTHTGEKPFKCGECGKAFNCGSNLLKHQKTHTGEKPYECTHCGKAFAYSSCLIRHQKRHPRKKPSGSPSSAASPGTTHPCPASFSARGRLSLPGLCAPTVLGPLASLLLLECQSLSSDPRPRNWATPRALLAQPSSQRGGLTYLDGLGTKVPQDLGHHHLLSFPSQPCSGAPGVPSAASVQPASAPRPSDVGGGPQPHRPAQHSGSPGSSPKVLSQPSDLDLQDVEEVEIGRDTFWPDSEPKPEQAPRSPGSQAPDEGAGGALRSLLRSLPRRARCSAGFGPESSAERPAGQPPGAVPCAQPRGAWRVTLVQQAAAGPEGAPERAAELGVNFGRSRQGSARGAKPHRCEACGKSFKYNSLLLKHQRIHTGEKPYACHECGKRFRGWSGFIQHHRIHTGEKPYECGQ

SEQ ID NO: 1488 - protein, 623 aa, Homo sapiens; identical to SEQ ID NO: 1319

SEQ ID NO: 1489 - protein, 746 aa, Homo sapiens; identical to SEQ ID NO: 1320

SEQ ID NO: 1490 - protein, 197 aa, Homo sapiens [sequence omitted]

SEQ ID NO: 1491 - protein, 394 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 1492 - protein, 1227 aa, Homo sapiens; identical to SEQ ID NO: 1125

SEQ ID NO: 1493 - protein, 6885 aa, Homo sapiens
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKIPRLLEPEDVDVVDPDEKSIMTYVAQFLQYSKDAPGTGEEAQGKVKDAMGWLTLQKEKLQKLLKDSENDTYFKKYNSLLSFMESFNEEKKSFLDVLSIKRDLDELDKDHLQLREAWDGLDHQINAWKIKLNYALPPPLHQTEAWLQEVEELMDEDLSASQDHSQAVTLIQEKMTLFKSLMDRFEHHSNILLTFENKDENHLPLVPPNKLEEMKRRINNILEKKFILLLEFHYYKCLVLGLVDEVKSKLDIWNIKYGSRESVELLLEDWHKFIEEKEFLARLDTSFQKCGEIYKNLAGECQNINKQYMMVKSDVCMYRKNIYNVKSTLQKVLACWATYVENLRLLRACFEETKKEEIKEVPFETLAQWNLEHATLNEAGNFLVEVSNDVVGSSISKELRRLNKRWRKLVSKTQLEMNLPLMIKKQDQPTFDNSGNILSKEEKATVEFSTDMSVELPENYNQNIKAGEKHEKENEEFTGQLKVAKDVEKLIGQVEIWEAEAKSVLDQDDVDTSMEESLKHLIAKGSMFDELMARSEDMLQMDIQNISSQESFQHVLTTGLQAKIQEAKEKVQINVVKLIAALKNLTDVSPDLDIRLKMEESQKELESYMMRAQQLLGQRESPGELISKHKEALIISNTKSLAKYLKAVEELKNNVTEDIKMSLEEKSRDVCAKWESLHHELSLYVQQLKIDIEKGKLSDNILKLEKQINKEKKLIRRGRTKGLIKEHEACFSEEGCLYQLNHHMEVLRELCEELPSQKSQQEVKRLLKDYEQKIERLLKCASEIHMTLQPTAGGTSKNEGTITTSENRGGDPHSEAPFAKSDNQPSTEKAMEPTMKFSLASVLRPLQEESIMEKDYSASINSLLERYDTYRDILEHHLQNNKFRITSDFSSEEDRSSSCLQAKLTDLQVIKNETDARWKEFEIISLKLENHVNDIKKPFVIKERDTLKERERELQMTLNTRMESLETALRLVLPVEKASLLLCGSDLPLHKMAIQGFHLIDADRIYQHLRNIQDSIAKQIEICNRLEEPGNFVLKELHPFDLHAMQNIILKYKTQFEGMNHRVQRSEDTLKALEDFLASLRTAKLSAEPVTDLSASDTQVAQENTLTVKNKEGEIHLMKDKAKHLDKCLKMLDMSFKDAERGDDTSCENLLDAFSIKLSETHGYGVQEEFTEENKLLEACIFKNNELLKNIQDVQSQISKIGLKDPTVPAVKHRKKSLIRLDKVLDEYEEEKRHLQEMANSLPHFKDGREKTVNQQCQNTVVLWENTKALVTECLEQCGRVLELLKQYQNFKSILTTLIQKEESVISLQASYMGKENLKKRIAEIEIVKEEFNEHLEVVDKINQVCKNLQFYLNKMKTFEEPPFEKEANIIVDRWLDINEKTEDYYENLGRALALWDKLFNLKNVIDEWTEKALQKMELHQLTEEDRERLKEELQVHEQKTSEFSRRVAEIQFLLQSSEIPLELQVMESSILNKMEHVQKCLTGESNCHALSGSTAELREDLDQAKTQIGMTESLLKALSPSDSLEIFTKLEEIQQQILQQKHSMILLENQIGCLTPELSELKKQYESVSDLFNTKKSVLQDHFSKLLNDQCKNFNDWFSNIKVNLKECFESSETKKSVEQKLQKLSDFLTLEGRNSKIKQVDSVLKHVKKHLPKAHVKELISWLVGQEFELEKMESICQARAKELEDSLQQLLRLQDDHRNLRKWLTNQEEKWKGMEEPGEKTELFCQALARKREQFESVAQLNNSLKEYGFTEEEEIIMEATCLMDRYQTLLRQLSEIEEEDKLLPTEDQSFNDLAHDVIHWIKEIKESLMVLNSSEGKMPLEERIQKIKEIILLKPEGDARIETIMKQAESSEAPLVQKTLTDISNQWDNTLHLASTYLSHQEKLLLEGEKYLQSKEDLRLMLIELKKKQEAGFALQHGLQEKKAQLKIYKKFLKKAQDLTSLLKELKSQGNYLLECTKNPSFSEEPWLEIKHLHESLLQQLQDSVQNLDGHVREHDSYQVCVTDLNTTLDNFSKEFVSFSDKPVDQIAVEEKLQKLQELENRLSLQDGTLKKILALAKSVKQNTSSVGQKIIKDDIKSLQCKQKDLENRLASAKQEMECCLNSILKSKRSTEKKGKFTLPGREKQATSDVQESTQESAAVEKLEEDWEINKDSAVEMAMSKQLSLNAQESMKNTEDERKVNELQNQPLELDTMLRNEQLEEIEKLYTQLEAKKAAIKPLEQTECLNKTETGALVLHNIGYSAQHLDNLLQALITLKKNKESQYCVLRDFQEYLAAVESSMKALLTDKESLKVGPLDSVTYLDKIKKFIASIEKEKDSLGNLKIKWENLSNHVTDMDKKLLESQIKQLEHGWEQVEQQIQKKYSQQVVEYDEFTTLMNKVQDTEISLQQQQQHLQLRLKSPEERAGNQSMIALTTDLQATKHGFSVLKGQAELQMKRIWGEKEKKNLEDGINNLKKQWETLEPLHLEAENQIKKCDIRNKMKETILWAKNLLGELNPSIPLLPDDILSQIRKCKVTHDGILARQQSVESLAEEVKDKVPSLTTYEGSDLNNTLEDLRNQYQMLVLKSTQRSQQLEFKLEERSNFFAIIRKFQLMVQESETLIIPRVETAATEAELKHHHVTLEASQKELQEIDSGISTHLQELTNIYEELNVFERLFLEDQLKNLKIRTNRIQRFIQNTCNEVEHKIKFCRQFHEKTSALQEEADSIQRNELLLNQEVNKGVKEEIYNLKDRLTAIKCCILQVLKLKKVFDYIGLNWDFSQLDQLQTQVFEKEKELEEKIKQLDTFEEEHGKYQALLSKMRAIDLQIKKMTEVVLKAPDSSPESRRLNAQILSQRIEKAKCLCDEIIKKLNENKTFDDSFKEKEILQIKLNAEENDKLYKVLQNMVLELSPKELDEKNCQDKLETSLHVLNQIKSQLQQPLLINLEIKHIQNEKDNCEAFQEQVWAEMCSIKAVTAIEKQREENSSEASDVETKLREFEDLQMQLNTSIDLRTNVLNDAYENLTRYKEAVTRAVESITSLEAIIIPYRVDVGNPEESLEMPLRKQEELESTVAHIQDLTEKLGMISSPEAKLQLQYTLQELVSKNSAMKEAFKAQETEAERYLENYKCYRKMEEDIYTNLSKMETVLGQSMSSLPLSYREALERLEQSKALVSNLISTKEELMKLRQILRLLRLRCTENDGICLLKIVSALWEKWLSLLEAAKEWEMWCEELKQEWKFVSEEIEREAIILDNLQEELPEISKTKEAATTEELSELLDCLCQYGENVEKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEQDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTMYNFRYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQNEIKRLYHQLIKSKTSLQQSLNEISGQSVAEQLQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKQFRAVRTTEGEEETESRVPGSTRPQRSFLSRVVRAALPLQLLLLLLLLLACLLPSSEEDYSCTQANNFARSFYPMLRYTNGPPPT

SEQ ID NO: 1494 - protein, 2843 aa, Homo sapiens
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQIAEIKEKIGTRSAEDPVSEVPAVSQHPRTKSSRLQGSSLSSESARHKAVEFSSGAKSPSKSGAQTPKSPPEHYVQETPLMFSRCTSVSSLDSFESRSIASSVQSEPCSGMVSGIISPSDLPDSPGQTMPPSRSKTPPPPPQTAQTKREVPKNKAPTAEKRESGPKQAAVNAAVQRVQVLPDADTLLHFATESTPDGFSCSSSLSALSLDEPFIQKDVELRIMPPVQENDNGNETESEQPKESNENQEKEAEKTIDSEKDLLDDSDDDDIEILEECIISAMPTKSSRKAKKPAQTASKLPPPVARKPSQLPVYKLLPSQNRLQPQKHVSFTPGDDMPRVYCVEGTPINFSTATSLSDLTIESPPNELAAGEGVRGGAQSGEFEKRDTIPTEGRSTDEAQGGKTSSVTIPELDDNKAEEGDILAECINSAMPKGKSHKPFRVKKIMDQVQQASASSSAPNKNQLDGKKKKPTSPVKPIPQNTEYRTRVRKNADSKNNLNAERVFSDNKDSKKQNLKNNSKVFNDKLPNNEDRVRGSFAFDSPHHYTPIEGTPYCFSRNDSLSSLDFDDDDVDLSREKAELRKAKENKESEAKVTSHTELTSNQQSANKTQAIAKQPINRGQPKPILQKQSTFPQSSKDIPDRGAATDEKLQNFAIENTPVCFSHNSSLSSLSDIDQENNNKENEPIKETEPPDSQGEPSKPQASGYAPKSFHVEDTPVCFSRNSSLSSLSIDSEDDLLQECISSAMPKKKKPSRLKGDNEKHSPRNMGGILGEDLTLDLKDIQRPDSEHGLSPDSENFDWKAIQEGANSIVSSLHQAAAAACLSRQASSDSDSILSLKSGISLGSPFHLTPDQEEKPFTSNKGPRILKPGEKSTLETKKIESESKGIKGGKKVYKSLITGKVRSNSEISGQMKQPLQANMPSISRGRTMIHIPGVRNSSSSTSPVSKKGPPLKTPASKSPSEGQTATTSPRGAKPSVKSELSPVARQTSQIGGSSKAPSRSGSRDSTPSRPAQQPLSRPIQSPGRNSISPGRNGISPPNKLSQLPRTSSPSTASTKSSGSGKMSYTSPGRQMSQQNLTKQTGLSKNASSIPRSESASKGLNQMNNGNGANKKVELSRMSSTKSSGSESDRSERPVLVRQSTFIKEAPSPTLRRKLEESASFESLSPSSRPASPTRSQAQTPVLSPSLPDMSLSTHSSVQAGGWRKLPPNLSPTIEYNDGRPAKRHDIARSHSESPSRLPINRSGTWKREHSKHSSSLPRVSTWRRTGSSSSILSASSESSEKAKSEDEKHVNSISGTKQSKENQVSAKGTWRKIKENEFSPTNSTSQTVSSGATNGAESKTLIYQMAPAVSKTEDVWVRIEDCPINNPRSGRSPTGNTPPVIDSVSEKANPNIKDSKDNQAKQNVGNGSVPMRTVGLENRLNSFIQVDAPDQKGTEIKPGQNNPVPVSETNESSIVERTPFSSSSSSKHSSPSGTVAARVTPFNYNPSPRKSSADSTSARPSQIPTPVNNNTKKRDSKTDSTESSGTQSPKRHSGSYLVTSV

SEQ ID NO: 1495 - protein, 152 aa, Homo sapiens
MSTPARRRLMRDFKRLQEDPPAGVSGAPSENNIMVWNAVIFGPEGTPFEDGTFKLTIEFTEEYPNKPPTVRFVSKMFHPNVYADGSICLDILQNRWSPTYDVSSILTSIQSLLDEPNPNSPANSQAAQLYQENKREYEKRVSAIVEQSWRDC

SEQ ID NO: 1496 - protein, 245 aa, Homo sapiens
SLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKADLQKLKDELASTKQKLEKAENQVLAMRKQSEGLTKEYDRLLEEHAKLQAAVDGPMDKKEE

SEQ ID NO: 1497 - protein, 1531 aa, Homo sapiens
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 1498 - protein, 1626 aa, Homo sapiens
MAKSGGCGAGAGVGGGNGALTWVTLFDQNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 1499 - protein, 769 aa, Homo sapiens
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNF

SEQ ID NO: 1500 - protein, 616 aa, Homo sapiens
MVGQLSEGAIAAIMQKGDTNIKPILQVINIRPITTGNSPPRYRLLMSDGLNTLSSFMLATQLNPLVEEEQLSSNCVCQIHRFIVNTLKDGRRVVILMELEVLKSAEAVGVKIGNPVPYNEGLGQPQVAPPAPAASPAASSRPQPQNGSSGMGSTVSKAYGASKTFGKAAGPSLSHTSGGTQSKVVPIASLTPYQSKWTICARVTNKSQIRTWSNSRGEGKLFSLELVDESGEIRATAFNEQVDKFFPLIEVNKVYYFSKGTLKIANKQFTAVKNDYEMTFNNETSVMPCEDDHHLPTVQFDFTGIDDLENKSKDSLVDIIGICKSYEDATKITVRSNNREVAKRNIYLMDTSGKVVTATLWGEDADKFDGSRQPVLAIKGARVSDFGGRSLSVLSSSTIIANPDIPEAYKLRGWFDAEGQALDGVSISDLKSGGVGGSNTNWKTLYEVKSENLGQGDKPDYFSSVATVVYLRKENCMYQACPTQDCNKKVIDQQNGLYRCEKCDTEFPNFKYRMILSVNIADFQENQWVTCFQESAEAILGQNAAYLGELKDKNEQAFEEVFQNANFRSFIFRVRVKVETYNDESRIKATVMDVKPVDYREYGRRLVMSIRRSALM

SEQ ID NO: 1501 - protein, 513 aa, Homo sapiens
MAELQMLLEEEIPGGRRALFDSYTNLERVADYCENNYIQSADKQRALEETKAYTTQSLASVAYLINTLANNVLQMLDIQASQLRRMESSINHISQTVDIHKEKVARREIGILTTNKNTSRTHKIIAPANLERPVRYIRKPIDYTILDDIGHGVKWLLRFKVSTQNMKMGGLPRTTPPTQKPPSPPMSGKGTLGRHSPYRTLEPVRPPVVPNDYVPSPTRNMAPSQQSPVRTASVNQRNRTYSSSGSSGGSHPSSRSSSRENSGSGSVGVPIAVPTPSPPSVFPAPAGSAGTPPLPATSASAPAPLVPATVPSSTAPNAAAGGAPNLADGFTSPTPPVVSSTPPTGHPVQFYSMNRPASRHTPPTIGGSLPYRRPPSITSQTSLQNQMNGGPFYSQNPVSDTPPPPPPVEEPVFDESPPPPPPPEDYEEEEAAVVEYSDPYAEEDPPWAPRSYLEKVVAIYDYTKDKEDELSFQEGAIIYVIKKNDDGWYEGVMNGVTGLFPGNYVESIMHYSE

SEQ ID NO: 1502 - protein, 377 aa, Homo sapiens
MKFPGPLENQRLSFLLEKAITREAQMWKVNVRKMPSNQNVSPSQRDEVIQWLAKLKYQFNLYPETFALASSLLDRFLATVKAHPKYLSCIAISCFFLAAKTVEEDERIPVLKVLARDSFCGCSSSEILRMERIILDKLNWDLHTATPLDFLHIFHAIAVSTRPQLLFSLPKLSPSQHLAVLTKQLLHCMACNQLLQFRGSMLALAMVSLEMEKLIPDWLSLTIELLQKAQMDSSQLIHCRELVAHHLSTLQSSLPLNSVYVYRPLKHTLVTCDKGVFRLHPSSVPGPDFSKDNSKPEVPVRGTAAFYHHLPAASGCKQTSTKRKVEEMEVDDFYDGIKRLYNEDNVSENVGSVCGTDLSRQEGHASPCPPLQPVSVM

SEQ ID NO: 1503 - protein, 297 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 1504 - protein, 361 aa, Homo sapiens
MSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDGGALGHHV

SEQ ID NO: 1505 - protein, 750 aa, Homo sapiens; identical to SEQ ID NO: 1312

SEQ ID NO: 1506 - protein, 4544 aa, Homo sapiens
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANAQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVGGAPPTVTLLRSERPPIFEIRMYDAQQQQVGTNKCRVNNGGCSSLCLATPGSRQCACAEDQVLDADGVTCLANPSYVPPPQCQPGEFACANSRCIQERWKCDGDNDCLDNSDEAPALCHQHTCPSDRFKCENNRCIPNRWLCDGDNDCGNSEDESNATCSARTCPPNQFSCASGRCIPISWTCDLDDDCGDRSDESASCAYPTCFPLTQFTCNNGRCININWRCDNDNDCGDNSDEAGCSHSCSSTQFKCNSGRCIPEHWTCDGDNDCGDYSDETHANCTNQATRPPGGCHTDEFQCRLDGLCIPLRWRCDGDTDCMDSSDEKSCEGVTHVCDPSVKFGCKDSARCISKAWVCDGDNDCEDNSDEENCESLACRPPSHPCANNTSVCLPPDKLCDGNDDCGDGSDEGELCDQCSLNNGGCSHNCSVAPGEGIVCSCPLGMELGPDNHTCQIQSYCAKHLKCSQKCDQNKFSVKCSCYEGWVLEPDGESCRSLDPFKPFIIFSNRHEIRRIDLHKGDYSVLVPGLRNTIALDFHLSQSALYWTDVVEDKIYRGKLLDNGALTSFEVVIQYGLATPEGLAVDWIAGNIYWVESNLDQIEVAKLDGTLRTTLLAGDIEHPRAIALDPRDGILFWTDWDASLPRIEAASMSGAGRRTVHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGQGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNLFWTSYDTNKKQINVARLDGSFKNAVVQGLEQPHGLVVHPLRGKLYWTDGDNISMANMDGSNRTLLFSGQKGPVGLAIDFPESKLYWISSGNHTINRCNLDGSGLEVIDAMRSQLGKATALAIMGDKLWWADQVSEKMGTCSKADGSGSVVLRNSTTLVMHMKVYDESIQLDHKGTNPCSVNNGDCSQLCLPTSETTRSCMCTAGYSLRSGQQACEGVGSFLLYSVHEGIRGIPLDPNDKSDALVPVSGTSLAVGIDFHAENDTIYWVDMGLSTISRAKRDQTWREDVVTNGIGRVEGIAVDWIAGNIYWTDQGFDVIEVARLNGSFRYVVISQGLDKPRAITVHPEKGYLFWTEWGQYPRIERSRLDGTERVVLVNVSISWPNGISVDYQDGKLYWCDARTDKIERIDLETGENREVVLSSNNMDMFSVSVFEDFIYWSDRTHANGSIKRGSKDNATDSVPLRTGIGVQLKDIKVFNRDRQKGTNVCAVANGGCQQLCLYRGRGQRACACAHGMLAEDGASCREYAGYLLYSERTILKSIHLSDERNLNAPVQPFEDPEHMKNVIALAFDYRAGTSPGTPNRIFFSDIHFGNIQQINDDGSRRITIVENVGSVEGLAYHRGWDTLYWTSYTTSTITRHTVDQTRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVILKSEPVHPFGLAVYGEHIFWTDWVRRAVQRANKHVGSNMKLLRVDIPQQPMGIIAVANDTNSCELSPCRINNGGCQDLCLLTHQGHVNCSCRGGRILQDDLTCRAVNSSCRAQDEFECANGECINFSLTCDGVPHCKDKSDEKPSYCNSRRCKKTFRQCSNGRCVSNMLWCNGADDCGDGSDEIPCNKTACGVGEFRCRDGTCIGNSSRCNQFVDCEDASDEMNCSATDCSSYFRLGVKGVLFQPCERTSLCYAPSWVCDGANDCGDYSDERDCPGVKRPRCPLNYFACPSGRCIPMSWTCDKEDDCEHGEDETHCNKFCSEAQFECQNHRCISKQWLCDGSDDCGDGSDEAAHCEGKTCGPSSFSCPGTHVCVPERWLCDGDKDCADGADESIAAGCLYNSTCDDREFMCQNRQCIPKHFVCDHDRDCADGSDESPECEYPTCGPSEFRCANGRCLSSRQWECDGENDCHDQSDEAPKNPHCTSPEHKCNASSQFLCSSGRCVAEALLCNGQDDCGDSSDERGCHINECLSRKLSGCSQDCEDLKIGFKCRCRPGFRLKDDGRTCADVDECSTTFPCSQRCINTHGSYKCLCVEGYAPRGGDPHSCKAVTDEEPFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 1507 - protein, 824 aa, Homo sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVDKKLDKQYESLSLFHPSNVEMLSSMDSASVRIIKPFPAPQTPGRLQPAPVIPSAPAAPKLDHQRMDTIQEDPSTDSHMDEDGFEKDPFPNSSTAAKSFEDLTDHPVTRSEKAASFKLQRQNRVDSKETEC

SEQ ID NO: 1508 - protein, 743 aa, Homo sapiens
EVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEGQLALLATQVEGQATNLQRLAEPSQLLKSAIVHLINYQDDAELVTRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMACAGRRAQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDMDATYRPMYSSDVPLDPLEMHMDMDGDYPIDTYSDGLRPPYPTADHMLA

SEQ ID NO: 1509 - protein, 913 aa, Homo sapiens
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 1510 - protein, 2701 aa, Homo sapiens
MTEKMSSFLYIGDIVSLYAEGSVNGFISTLGLVDDRCVVHPEAGDLANPPKKFRDCLFKVCPMNRYSAQKQYWKAKQAKQGNHTEAALLKKLQHAAELEQKQNESENKKLLGEIVKYSNVIQLLHIKSNKYLTVNKRLPALLEKNAMRVSLDAAGNEGSWFYIHPFWKLRSEGDNIVVGDKVVLMPVNAGQPLHASNIELLDNPGCKEVNAVNCNTSWKITLFMKYSSYREDVLKGGDVVRLFHAEQEKFLTCDEYEKKQHIFLRTTLRQSATSATSSKALWEIEVVHHDPCRGGAGQWNSLFRFKHLATGNYLAAELNPDYRDAQNEGKNVRDGVPPTSKKKRQAGEKIMYTLVSVPHGNDIASLFELDATTLQRADCLVPRNSYVRLRHLCTNTWVTSTSIPIDTDEERPVMLKIGTCQTKEDKEAFAIVSVPLSEVRDLDFANDANKVLATTVKKLENGTITQNERRFVTKLLEDLIFFVADVPNNGQEVLDVVITKPNRERQKLMREQNILAQVFGILKAPFKEKAGEGSMLRLEDLGDQRYAPYKYMLRLCYRVLRHSQQDYRKNQEYIAKNFCVMQSQIGYDILAEDTITPLLHNNRKLLEKHITAKEIETFVSLLRRNREPRFLDYLSDLCVSNTTAIPVTQELICKFMLSPGNADILIQTKVVSMQADNPMESSILSDDIDDEEVWLYWIDSNKEPHGKAIRHLAQEAKEGTKADLEVLTYYRYQLNLFARMCLDRQYLAINQISTQLSVDLILRCVSDESLPFDLRASFCRLMLHMHVDRDPQESVVPVRYARLWTEIPTKITIHEYDSITDSSRNDMKRKFALTMEFVEEYLKEVVNQPFPFGDKEKNKLTFEVVHLARNLIYFGFYSFSELLRLTRTLLAILDIVQAPMSSYFERLSKFQDGGNNVMRTIHGVGEMMTQMVLSRGSIFPMSVPDVPPSIHPSKQGSPTEHEDVTVMDTKLKIIEILQFILSVRLDYRISYMLSIYKKEFGEDNDNAETSASGSPDTLLPSAIVPDIDEIAAQAETMFAGRKEKNPVQLDDEGGRTFLRVLIHLIMHDYAPLLSGALQLLFKHFSQRAEVLQAFKQVQLLVSNQDVDNYKQIKADLDQLRLTVEKSELWVEKSSNYENGEIGESQVKGGEEPIEESNILSPVQDGTKKPQIDSNKSNKYRIVKEILIRLSKLCVQNKKCRNQHQRLLKNMGAHSVVLDLLQIPYEKNDEKMNEVMNLAHTFLQNFCRGNPQNQVLLHKHLNLFLTPGLLEAETMRHIFMNNYHLCNEISERVVQHFVHCIETHGRHVEYLRFLQTIVKADGKYVKKCQDMVMTELINGGEDVLIFYNDRASFPILLHMMCSERDRGDESGPLAYHITLVELLAACTEGKNVYTEIKCNSLLPLDDIVRVVTHDDCIPEVKIAYVNFVNHCYVDTEVEMKEIYTSNHIWKLFENFLVDMARVCNTTTDRKHADIFLEKCVTESIMNIVSGFFNSPFSDNSTSLQTHQPVFIQLLQSAFRIYNCTWPNPAQKASVESCIRTLAEVAKNRGIAIPVDLDSQVNTLFMKSHSNMVQRAAMGWRLSARSGPRFKEALGGPAWDYRNIIEKLQDVVASLEHQFSPMMQAEFSVLVDVLYSPELLFPEGSDARIRCGAFMSKLINHTKKLMEKEEKLCIKILQTLREMLEKKDSFVEEGNTLRKILLNRYFKGDYSIGVNGHLSGAYSKTAQVGGSFSGQDSDKMGISMSDIQCLLDKEGASELVIDVIVNTKNDRIFSEGIFLGIALLEGGNTQTQYSFYQQLHEQKKSEKFFKVLYDRMKAAQKEIRSTVTVNTIDLGNKKRDDDNELMTSGPRMRVRDSTLHLKEGMKGQLTEASSATSKAYCVYRREMDPEIDIMCTGPEAGNTEEKSAEEVTMSPAIAIMQPILRFLQLLCENHNRELQNFLRNQNNKTNYNLVCETLQFLDCICGSTTGGLGLLGLYINEKNVALVNQNLESLTEYCQGPCHENQTCIATHESNGIDIIIALILNDINPLGKYRMDLVLQLKNNASKLLLAIMESRHDSENAERILFNMRPRELVDVMKNAYNQGLECDHGDDEGGDDGVSPKDVGHNIYILAHQLARHNKLLQQMLKPGSDPDEGDEALKYYANHTAQIEIVRHDRTMEQIVFPVPNICEYLTRESKCRVFNTTERDEQGSKVNDFFQQTEDLYNEMKWQKKIRNNPALFWFSRHISLWGSISFNLAVFINLAVALFYPFGDDGDEGTLSPLFSVLLWIAVAICTSMLFFFSKPVGIRPFLVSIMLRSIYTIGLGPTLILLGAANLCNKIVFLVSFVGNRGTFTRGYRAVILDMAFLYHVAYVLVCMLGLFVHEFFYSFLLFDLVYREETLLNVIKSVTRNGRSIILTAVLALILVYLFSIIGFLFLKDDFTMEVDRLKNRTPVTGSHQVPTMTLTTMMEACAKENCSPTIPASNTADEEYEDGIERTCDTLLMCIVTVLNQGLRNGGGVGDVLRRPSKDEPLFAARVVYDLLFYFIVIIIVLNLIFGVIIDTFADLRSEKQKKEEILKTTCFICGLERDKFDNKTVSFEEHIKSEHNMWHYLYFIVLVKVKDPTEYTGPESYVAQMIVEKNLDWFPRMRAMSLVSNEGDSEQNEIRSLQEKLESTMSLVKQLSGQLAELKEQMTEQRKNKQRLGFLGSNTPHVNHHMPPH

SEQ ID NO: 1511 - protein, 606 aa, Homo sapiens; identical to SEQ ID NO: 1168

SEQ ID NO: 1512 - protein, 317 aa, Homo sapiens
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPTSNTYTLVTCLGLSYDGLLGNNQIFPKTGLLIIVLGTIAMEGDSASEEEIWEELGVMGVYDGREHTVYGEPRKLLTQDWVQENYLEYRQVPGSNPARYEFLWGPRALAETSYVKVLEHVVRVNARVRIAYPSLREAALLEEEEGV

SEQ ID NO: 1513 - protein, 1139 aa, Homo sapiens
MPSGGDQSPPPPPPPPAAAASDEEEEDDGEAEDAAPSAESPTPQIQQRFDELCSRLNMDEAARAEAWDSYRSMSESYTLEGNDLHWLACALYVACRKSVPTVSKGTVEGNYVSLTRILKCSEQSLIEFFNKMKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPLTPRRVTEVRADTGGLGRSITSPTTLYDRYSSPPASTTRRRLFVENDSPSDGGTPGRMPPQPLVNAVPVQNVSGETVSVTPVPGQTLVTMATATVTANNGQTVTIPVQGIANENGGITFFPVQVNVGGQAQAVTGSIQPLSAQALAGSLSSQQVTGTTLQVPGQVAIQQISPGGQQQKQGQSVTSSSNRPRKTSSLSLFFRKVYHLAAVRLRDLCAKLDISDELRKKIWTCFEFSIIQCPELMMDRHLDQLLMCAIYVMAKVTKEDKSFQNIMRCYRTQPQARSQVYRSVLIKGKRKRRNSGSSDSRSHQNSPTELNKDRTSRDSSPVMRSSSTLPVPQPSSAPPTPTRLTGANSDMEEEERGDLIQFYNNIYIKQIKTFAMKYSQANMDAPPLSPYPFVRTGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 1514 - protein, 9 aa, Homo sapiens
KIMDQVQQA

SEQ ID NO: 1515 - protein, 10 aa, Homo sapiens
RLQEDPPAGV

SEQ ID NO: 1516 - protein, 9 aa, Homo sapiens
KLDVGNAEV

SEQ ID NO: 1517 - protein, 9 aa, Homo sapiens
FLYDDNQRV

SEQ ID NO: 1518 - protein, 9 aa, Homo sapiens
FLYDDNQRV

SEQ ID NO: 1519 - protein, 9 aa, Homo sapiens
ALMEQQHYV

SEQ ID NO: 1520 - protein, 9 aa, Homo sapiens
YLMDTSGKV

SEQ ID NO: 1521 - protein, 9 aa, Homo sapiens
ILDDIGHGV

SEQ ID NO: 1522 - protein, 9 aa, Homo sapiens
LLDRFLATV

SEQ ID NO: 1523 - protein, 11 aa, Homo sapiens
LLIDDKGTIKL

SEQ ID NO: 1524 - protein, 10 aa, Homo sapiens
RLYPWGVVEV

SEQ ID NO: 1525 - protein, 9 aa, Homo sapiens
KLQELNYNL

SEQ ID NO: 1526 - protein, 9 aa, Homo sapiens
ILIEHLYGL

SEQ ID NO: 1527 - protein, 9 aa, Homo sapiens
YLIELIDRV

SEQ ID NO: 1528 - protein, 9 aa, Homo sapiens
NLMEQPIKV

SEQ ID NO: 1529 - protein, 10 aa, Homo sapiens
FLAEDALNTV

SEQ ID NO: 1530 - protein, 9 aa, Homo sapiens
TLLNVIKSV

SEQ ID NO: 1531 - protein, 9 aa, Homo sapiens
MLKDIIKEY

SEQ ID NO: 1532 - protein, 9 aa, Homo sapiens
TSYVKVLEH

SEQ ID NO: 1533 - protein, 9 aa, Homo sapiens
HEYLKAFKV

We claim:

1. A method for eliciting a CTL response against tumor cells presenting at least one of the following epitopic peptides: SEQ ID NO: 1516, 1517, 1519, 1521, 1527, 1528, or 1529 in a subject, comprising administering to said subject a composition comprising at least one polypeptide comprising an epitopic peptide comprising an amino acid sequence selected from the group consisting of SEQ ID NO: 1516, 1517, 1519, 1521, 1527, 1528, and 1529 in an amount sufficient to induce a CTL response to said tumor cells.

2. The method of claim 1, wherein said composition further comprises an adjuvant.

3. The method of claim 2, wherein said adjuvant is selected from the group consisting of complete Freund's adjuvant, incomplete Freund's adjuvant, Montanide ISA-51, LAG-3, aluminum phosphate, aluminum hydroxide, alum, and saponin.

4. The method of claim 1, wherein said composition further comprises a cytokine.

5. The method of claim 4, wherein said cytokine is GM-CSF.

6. The method of claim 1, wherein said composition further comprises a vehicle.

7. The method of claim 6, where said vehicle is selected from the group consisting of a liposome, an immunostimulating complex (ISCOM), and slow-releasing particles.

8. The method of claim 7, wherein said liposome comprises an emulsion, a foam, a micelle, an insoluble monolayer, a liquid crystal, a phospholipid dispersion, or a lamellar layer.

9. The method of claim 1, wherein said polypeptide consists of an amino acid sequence selected from the group consisting of SEQ ID NO: 1516, 1517, 1519, 1521, 1527, 1528, and 1529.

10. The method of claim 1 wherein said tumor cells are part of a carcinoma.

11. The method of claim 1 wherein said tumor cells are part of an ovarian carcinoma.

12. The method of claim 1 wherein said polypeptide comprises at least two epitopic peptides.

13. The method of claim 12 wherein said polypeptide comprises at least three epitopic peptides.

14. The method of claim 12, wherein said polypeptide comprises a first epitopic peptide and a second epitopic peptide, wherein said first epitopic peptide comprises an amino acid sequence selected from the group consisting of SEQ ID NO: 1516, 1517, 1519, 1521, 1527, 1528, and 1529 and said second epitopic peptide comprises an amino acid sequence selected from the group consisting of SEQ ID NO: 1516, 1517, 1519, 1521, 1527, 1528, and 1529.

* * * * *

UNITED STATES PATENT AND TRADEMARK OFFICE
CERTIFICATE OF CORRECTION

PATENT NO. : 7,919,467 B2 Page 1 of 1
APPLICATION NO. : 11/426161
DATED : April 5, 2011
INVENTOR(S) : Ramakrishna et al.

It is certified that error appears in the above-identified patent and that said Letters Patent is hereby corrected as shown below:

On the Title Page:

Item (75) should read   Inventors:   Venky Ramakrishna, Riegelsville, PA (US); Mark M. Ross, Charlottesville, VA (US); Ramila Philip, Ivyland, PA (US)

"Lorraine H. Keller" has been deleted as an inventor.

Signed and Sealed this
Seventeenth Day of May, 2011

David J. Kappos
*Director of the United States Patent and Trademark Office*